US008906610B2

(12) United States Patent
Brodie et al.

(10) Patent No.: US 8,906,610 B2
(45) Date of Patent: *Dec. 9, 2014

(54) USING PHYLOGENETIC PROBES FOR QUANTIFICATION OF STABLE ISOTOPE LABELING AND MICROBIAL COMMUNITY ANALYSIS

(75) Inventors: Eoin L. Brodie, Piedmont, CA (US); Todd Z. DeSantis, Livermore, CA (US); Ulas Karaoz, Berkeley, CA (US); Gary L. Andersen, Berkeley, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/023,538

(22) Filed: Feb. 8, 2011

(65) Prior Publication Data

US 2011/0212850 A1   Sep. 1, 2011

Related U.S. Application Data

(60) Provisional application No. 61/302,535, filed on Feb. 8, 2010, provisional application No. 61/302,827, filed on Feb. 9, 2010.

(51) Int. Cl.
| | | |
|---|---|---|
| *C12Q 1/68* | (2006.01) | |
| *C12Q 1/04* | (2006.01) | |
| *C12Q 1/16* | (2006.01) | |
| *G01N 33/68* | (2006.01) | |

(52) U.S. Cl.
CPC .......... *G01N 33/6848* (2013.01); *C12Q 1/6837* (2013.01)
USPC ............ 435/6.1; 435/6.11; 435/6.15; 435/34; 435/35

(58) Field of Classification Search
None
See application file for complete search history.

(56) References Cited

U.S. PATENT DOCUMENTS

| | | |
|---|---|---|
| 7,015,471 B2 | 3/2006 | Franzen et al. |
| 2004/0058380 A1 | 3/2004 | Levon et al. |
| 2004/0086423 A1* | 5/2004 | Wohlstadter et al. ........... 422/52 |
| 2004/0180369 A1 | 9/2004 | Franzen et al. |
| 2005/0244414 A1 | 11/2005 | Mundy et al. |
| 2006/0147969 A1 | 7/2006 | Kuimelis et al. |
| 2008/0076128 A1 | 3/2008 | Hah et al. |
| 2008/0182758 A1 | 7/2008 | Ugolin et al. |
| 2009/0137426 A1 | 5/2009 | Jung et al. |
| 2009/0203549 A1 | 8/2009 | Hoeprich |
| 2009/0291858 A1 | 11/2009 | Andersen et al. |

FOREIGN PATENT DOCUMENTS

| | | |
|---|---|---|
| WO | 00/65099 A1 | 11/2000 |
| WO | 2006/054297 A2 | 5/2006 |
| WO | 2006/078356 A1 | 7/2006 |
| WO | 2006/114420 A1 | 11/2006 |
| WO | 2007/050501 A2 | 5/2007 |
| WO | 2008/028206 A2 | 3/2008 |
| WO | 2009/100201 A2 | 8/2009 |

OTHER PUBLICATIONS

Hesselsoe et al., Isotope array analysis of Rhodocyclales uncovers functional redundancy and versatility in an activated sludge; The ISME Journal, vol. 3, pp. 1349-1364, 2009.*
Li et al., Simultaneous analysis of microbial identity and function using NanoSIMS; Environmental Microbiology, vol. 10, No. 3, pp. 580-588, 2008.*
Godin et al., Simultaneous measurement of 13C- and 15N-isotopic enrichments of threonine by mass spectrometry; Rapid Communications in Mass Spectrometry, vol. 23, pp. 1109-1115, 2009.*
Adamczyk, J. et al. (Nov. 2003). "The Isotope Array, A New Tool that Employs Substrate-Mediated Labeling of rRNA for Determination of Microbial Community Structure and Function," Applied and Environmental Microbiology 69 (11):6875-6887.
Addison, S. L. et al. (2010). "Stable Isotope Probing: Technical Considerations when Resolving 15N-Labeled RNA in Gradients," Journal of Microbiological Methods 80:70-75.
Ammerman, J. W. et al. (Mar. 15, 1985). "Bacterial 5'-Nucleotidase in Aquatic Ecosystems: A Novel Mechanism of Phosphorous Regeneration," Science 227:1338-1340.
Behrens, S. et al. (May 2008). "Linking Microbial Phylogeny to Metabolic Activity at the Single-Cell Level by Using Enhanced Element Labeling-Catalyzed Reporter Deposition Fluorescence in Situ Hybridization (EL-FISH) and NanoSIMS," Applied and Environment Microbiology 74(1):3143-3150.
Boschker, H. T. S. et al. (Apr. 23, 1998). "Direct Linking of Microbial Populations to Specific Biogeochemical Processes by 13C-Labelling of Biomarkers," Nature 392:801-805.
Brodie, E. L. et al. (Sep. 2006). "Application of a High-Density Oligonucleotide Microarray Approach to Study Bacterial Population Dynamics During Uranium Reduction and Reoxidation," Applied and Environmental Microbiology 72(9):6288-6298.
Cline, M. S. et al. (2007). "Integration of Biological Networks and Gene Expression Data Using Cytoscape," Nature Protocols 2(10):2366-2382.
DeFlaun, M. F. et al. (May 21, 1987). "Distribution and Molecular Weight of Dissolved DNA in Subtropical Estuarine and Oceanic Environments," Marine Ecology-Progress Series 38:65-73.
DeLong, E. F. et al. (Jan. 27, 2006). "Community Genomics Among Stratified Microbial Assemblages in the Ocean's Interior," Science 311:496-503.
DeSantis, T. Z. et al. (Jul. 2006). "Greengenes, A Chimera-Checked 16S rRNA Gene Database and Workbench Compatible with ARB," Applied and Environmental Microbiology 72(7):5069-5072.
Doolittle, W. F. et al. (2009). "On the Origin of Prokaryotic Species," Genome Research 19:744-756.

(Continued)

*Primary Examiner* — Jennifer Dunston
*Assistant Examiner* — Addison D Ault
(74) *Attorney, Agent, or Firm* — Michelle Chew Wong; Lawrence Berkeley National Laboratory

(57) ABSTRACT

Herein is described methods for a high-sensitivity means to measure the incorporation of stable isotope labeled substrates into RNA following stable isotope probing experiments (SIP). RNA is hybridized to a set of probes such as phylogenetic microarrays and isotope incorporation is quantified such as by secondary ion mass spectrometer imaging (Nano-SIMS).

43 Claims, 17 Drawing Sheets

(56) References Cited

OTHER PUBLICATIONS

Dugdale, R. C. et al. (2007). "The Role of Ammonium and Nitrate in Spring Bloom Development in San Francisco Bay," Estuarine, Coastal and Shelf Science 73:17-29.

Dumont, M. G. et al. (Jun. 2005). "Stable Isotope Probing: Linking Microbial Identity to Function," Nature Reviews Microbiology 3:499-504.

Evens, R. et al. (1988). "A Seasonal Comparison of the Dissolved Free Amino Acid Levels in Estuarine and English Channel Waters," The Science of the Total Environment 76:69-78.

Falkowski, P. et al. (Oct. 13, 2000). "The Global Carbon Cycle: A Test of Our Knowledge of Earth as a System," Science 290:291-296.

Fernandez-Reiriz, M. J. et al. (1989). "Biomass Production and Variation in the Biochemical Profile (Total Protein, Carbohydrates, RNA, Lipids and Fatty Acids) of Seven Species of Marine Microalgae," Aquaculture 83:17-37.

Fuhrman, J. A. et al. (Jun. 1980). "Bacterioplankton Secondary Production Estimates for Coastal Waters of British Columbia, Canada, Antarctica, and California," Applied and Environmental Microbiology 39(6):1085-1095.

Giovannoni, S. J. et al. (Sep. 15, 2005). "Molecular Diversity and Ecology of Microbial Plankton," Nature 437:343-348.

Goldman, J. C. et al. (1991). "Ammonium Regeneration and Carbon Utilization by Marine Bacteria Grown on Mixed Substrates," Marine Biology 109:369-378.

Hanson, R. B. et al. (1980). "Glucose Exchanges in a Salt Marsh-Estuary: Biological Activity and Chemical Measurements," Limnology and Oceanography 25(4):633-642.

Hunt, D. E. et al. (May 23, 2008). "Resource Partitioning and Sympatric Differentiation Among Closely Related Bacterioplankton," Science 320:1081-1085.

Kirchman, D. et al. (Mar. 1985). "Leucine Incorporation and its Potential as a Measure of Protein Synthesis by Bacteria in Natural Aquatic Systems," Applied and Environmental Microbiology 49(3):599-607.

Lauro, F. M. et al. (Sep. 15, 2009). "The Genomic Basis of Trophic Strategy in Marine Bacteria," Proceedings of the National Academy of Sciences of the United States of America 106(37):15527-15533.

Lennon, J. T. (May 2007). "Diversity and Metabolism of Marine Bacteria Cultivated on Dissolved DNA," Applied and Environmental Microbiology 73(9):2799-2805.

Ludwig, W. et al. (2004). "ARB: A Software Environment for Sequence Data," Nucleic Acids Research 32 (4):1363-1371.

Manefield, M. et al. (Nov. 2002). "RNA Stable Isotope Probing, A Novel Means of Linking Microbial Community Function to Phylogeny," Applied and Environmental Microbiology 68(11):5367-5373.

Martinez, J. et al. (Jun. 27, 1996). "Variability in Ectohydrolytic Enzyme Activities of Pelagic Marine Bacteria and its Significance for Substrate Processing in the Sea," Aquatic Microbial Ecology 10:223-230.

Murrell, J. C. et al. eds. (Dec. 2010). Stable Isotope Probing and Related Technologies. ASM Press: Washington D.C. (Table of Contents only, 4 pages).

Neufeld, J. D. et al. (2007). "Who Eats What, Where and When? Isotope-Labelling Experiments are Coming of Age," The ISME Journal 1:103-110.

Ouverney, C. C. et al. (Apr. 1999). "Combined Microautoradiography-16S rRNA Probe Technique for Determination of Radioisotope Uptake by Specific Microbial Cell Types in Situ," Applied and Environmental Microbiology 65 (4):1746-1752.

Pomeroy, L. R. et al. (2007). "The Microbial Loop," Oceanography 20(2):28-33.

Poretsky, R. S. et al. (2010). "Transporter Genes Expressed by Coastal Bacterioplankton in Response to Dissolved Organic Carbon," Environmental Microbiology 12(3):616-627.

Radajewski, S. et al. (Feb. 10, 2000). "Stable-Isotope Probing as a Tool in Microbial Ecology," Nature 403:646-649.

Rappe, M. S. et al. (1997). "Phylogenetic Diversity of Marine Coastal Picoplankton 16S rRNA Genes Cloned from the Continental Shelf Off Cape Hatteras, North Carolina," Limnology and Oceanography 42(5):811-826.

Rappe, M. S. et al. (Aug. 8, 2002). "Cultivation of the Ubiquitous SAR11 Marine Bacterioplankton Clade," Nature 418:630-633.

Singh-Gasson, S. et al. (Oct. 1999). "Maskless Fabrication of Light-Directed Oligonucleotide Microarrays Using a Digital Micromirror Array," Nature Biotechnology 17:974-978.

Stauffer, T. B. et al. (Dec. 1970). "Dissolved Fatty Acids in the James River Estuary, Virginia, and Adjacent Ocean Waters," Chesapeake Science 11(4):216-220.

Suttle, C. A. et al. (1990). "Rapid Ammonium Cycling and Concentration-Dependent Partitioning of Ammonium and Phosphate: Implications for Carbon Transfer in Planktonic Communities," Limnology and Oceanography 35 (2):424-433.

Uhlik, O. et al. (2009). "DNA-Based Stable Isotope Probing: A Link Between Community Structure and Function," Science of the Total Environment 407:3611-3619.

U.S. Office Action mailed on Oct. 26, 2012, for U.S. Appl. No. 13/023,468, filed Feb. 8, 2011, 12 pages.

U.S. Office Action mailed on Aug. 31, 2012, for U.S. Appl. No. 13/023,468, filed Feb. 8, 2011, 5 pages.

Cole, K., et al., Direct labeling of RNA with multiple biotins allows sensitive expression profiling acute leukemia class predictor genes, Nucleic Acids Research 2004, 32: e86.

Curtis, T., et al., Estimating prokaryotic diversity and its limits. PNAS 2002, 99: 10494-10499.

DeSantis, TZ, et al., Comprehensive aligned sequence construction for automated design of effective probes (cascade-p) using 16S rDNA, Bioinformatics 2003, 19: 1461-1468.

Marxer, C.G., et al., Supported membrane composition analysis by secondary ion mass spectrometry with high lateral resolution, Biophysical Journal 2005, 88: 2965-2975.

Gans, J., et al., Computational improvements reveal great bacterial diversity and high metal toxicity in soil, Science 2005, 309: 1387-1390.

Ghosal, S., et al., Analysis of bacterial spore permeability to water and ions using nano-secondary ion mass spectrometry (NanoSIMS), 232nd American Chemical Society National Meeting, Boston MA Aug. 19-23, 2007.

Gilbert, D., NewsOnLine newsletter, Lawrence Livermore National Laboratory Mar. 16, 2007.

Goodfellow, M., et al., Roots of bacterial systematic, In: Handbook of new bacterial systematic, 1993, pp. 2-54.

Hallegot, P. et al., In-Situ Imaging Mass Spectrometry Analysis of Melanin Granules in the Human Hair Shaft, Journal of Investigative Dermatology, 2004, vol. 122, pp. 381-386.

Hillion, F., et al., A new high performance SIMS instrument: The cameca "Nanosims 50", Secondary Ion Mass Spectrometry SIMS IX, 1993, pp. 254-257.

Horner-Devine, M., et al., An ecological perspective on bacterial biodiversity, Proceedings of the Royal Society of London—Series B: Biological Sciences 2004, 271: 113-122.

Hu, P., et al., Whole-genome transcriptional analysis of heavy metal stresses in *Caulobactor crescentus*, Journal of Bacteriology 2005, 187: 8437-8449.

Jeffries, TW, et al., Genome sequence of the lignocelluloses-bioconverting and xylose-fermenting yeast *Pichia stipitis*, Nature Biotechnology 2007, 25: 319-326.

Kleinfeld, MA, et al., Transport of 13C-oleate in adipocytes measured using multi-imaging mass spectrometry, Journal of the American Society for Mass Spectrometry 2004, 15: 1572-1580.

Klug, MJ, et al., Response of microbial communities to changing environmental conditions: Chemical and physiological approaches, In: Trends in microbial ecology, Spanish Society for Microbiology 1993, pp. 371-374.

Kraft, ML, et al., Phase separation of lipid membranes analyzed with high-resolution secondary mass ion spectrometry, Science 2006, 313: 1948-1951.

Kraft, ML, et al., Quantitative analysis of supported membrane composition using the NanoSIMS, Applied Surface Science 2006, 252: 6950-6956.

(56) References Cited

OTHER PUBLICATIONS

Kuypers, MM, et al., The future of single-cell environmental microbiology, Environmental Microbiology 2007, 9: 6-7.

Lehner, A., et al., Oligonucleotide microarray for identification of entrerococcus species, FEMS Microbiology Letters 2005, 246: 133-142.

Lin, LH, et al., Long-Term Sustainability of a High-Energy, Low-Diversity Crustal Biome, Science 2006, 314: 479-482.

Loy, A, et al., 16S rRNA Gene-Based Oligonucleotide Microarray for Environmental Monitoring of the Betaproteobacterial Order "Rhodocyclales", Appl. Environ. Microbiol. 2005, 71: 1373-1386.

MacGregor, BJ, et al., Isolation of small sub-unit rRNA for stable isotopic characterization, Environmental Microbiology 2002, 4: 451-464.

McMahon, G., et al. Quantitative imaging of cells with multi-isotope imaging mass spectrometry (MIMS)—nanoautography with stable isotope tracers, Appl. Surface Science 2006, 252: 6895-6906.

Moreau, JW, et al., Extracellular Proteins Limit the Dispersal of Biogenic Nanoparticles, Science 2007, 316: 1600-1603.

Moreau, JW, et al., Submicron-scale isotopic variations within biogene ZnS record the mechanism and kinetics of extracellular metal-sulfide biomineralization, presented at the Goldschmidt Conference, Melbourne Australia, Aug. 27, 2006 in Geochimica et Cosmochimica Acta 2006, 70: A428.

Nannipieri, P., et al., Microbial diversity and soil functions, Eur. Soil Sci. 2003, 54: 655-670.

Nardi, JB, et al., Communities of microbes that inhabit the changing hindgut landscape of a subsocial beetle, Arthropod Structure and Development 2006, 35: 57-68.

Nguyen, N.H. et al., *Metschnikowia noctiluminum* sp. nov., *Metschnikowia corniflorae* sp. nov., and *Candida chrysomelidarum* sp. nov., isolated from green lacewings and beetles, Mycological Research, 2006, 110: 346-356.

Orphan, JV, et al., Methane-consuming archaea revealed by directly coupled isotopic and phylogenetic analysis, Science 2001, 293: 484-487.

Peteranderl, R., et al., Measure of carbon and nitrogen stable isotope ratios in cultured cells, Journal of the American Society for Mass Spectrometry 2004, 15: 478-485.

Pett-Ridge, J., et al., Redox fluctuation structures in microbial communities in a wet tropical soil, Appl. Environ. Microbiol. 2005, 71: 6998-7007.

Pett-Ridge, J., et al., NanoSIMS analyses of molybdenum indicate nitrogenase activity and help solve a N and C fixation puzzle in a marine cyanobacterium, American Geophysical Union Fall Meeting 2006, San Francisco.

Phelps, TJ, et al. Comparison between geochemical and biological estimates of subsurface microbial activities, Microbial Ecology 1994, V28: 335-349.

Popa, R., et al., Carbon and nitrogen fixation and mobilization in and between individual cells of *Anabaena oscillarioides*, ISME 2007, 1: 1-7.

Radajewski, S. et al., Identification of active methylotroph populations in an acidic forest soil by stable-isotope probing, Microbiology 2002, 148: 2331-2342.

Radajewski, S., et al., Stable-isotope probing of nucleic acids: a window to the function of uncultured microorganisms, Current Opinion in Biotechnology 2004, 14: 296-302.

Rhee, SK, et al., Detection of Genes Involved in Biodegradation and Biotransformation in Microbial Communities by Using 50-Mer Oligonucleotide Microarrays, Applied and Environmental Microbiology 2004, 70: 4303-4317.

Romer, W., et al., Sub-cellular localization of a 15N-labelled peptide vector using NanoSIMS imaging, Applied Surface Science 2006, 252: 6925-6930.

Rosello-Mora, R., et al., The species concept for prokaryotes, FEMS Microbiology Reviews 2001, 25: 39-67.

Schubert, C., Can biofuels finally take center stage?, Nature Biotechnology 2006, 24: 777-784.

Small, JD, et al., Direct detection of 16S rRNA in soil extracts by using oligonucleotide microarrays, Applied and Environmental Microbiology 2001, 67: 4708-4716.

Smyth, C., et al., Auto-associative multivariate regression trees for cluster analysis. Chemometrics and Intelligent Laboratory Systems 2006, 80: 120-129.

Stadermann, FJ, et al., Sub-micron isotopic measurements with the Cameca NanoSIMS, 30th Lunar and Planetary Science Conference, Houston TX 1999.

Suh, S., et al., Wood ingestion by passalid beetles in the presence of xylose-fermenting gut yeasts, Molecular Ecology 2003, 12: 3137-3145.

Suh, S., et al., Expansion of the *Candida tanzawaensis* yeast clade: 16 novel *Candida* species from basidiocarp-feeding beetles, International Journal of Systematics and Evolutionary Microbiology 2004, 54: 2409-2429.

Torsvik, V., et al., High diversity in DNA of soil bacteria, Applied and Environmental Microbiology 1990, 56: 782-787.

Torsvik, V., et al., Microbial diversity and function in soil: from genes to ecosystems, Current Opinion in Microbiology 2002, 5: 240-245.

van Belkum, A., et al., Nonisotopic labeling of DNA by newly developed hapten-containing platinum compounds, Biotechniques 1994, 16: 148-153.

van der Laan, MJ, et al., A new algorithm for hybrid hierarchical clustering visualization and the bootstrap, Journal of Statistical Planning and Inference 2003, 117: pp. 275-303.

Wainwright, M., et al., Studies of bacteria-like particles sampled from the stratosphere, Acorobiologia 2004, 20: 1-10.

Wan, JM, et al., Reoxidation of bioreduced uranium under reducing conditions, Environmental Science & Technology 2005, 39: 6162-6169.

Weber, PK, et al., Chemical imaging of biological materials by NanoSIMS, 31st FACSS Meeting, Portland OR, Oct. 3-7, 2004.

Weber, PK, et al., High resolution trace element and isotopic imaging of microbial systems by NanoSims, American Geophysical Union Fall Meeting, San Francisco CA, Dec. 5-9, 2005.

Wellington, EM, et al., Resolving functional diversity in relation to microbial community structure in soil: exploiting genomics and stable isotopic probing, Current Opinion in Microbiology 2003, 6: 295-301.

White, RH, The difficult road from sequence to function, J. Bacteriol. 2006, 188: 3431-3432.

Whitman, W.B. et al., Perspective: Prokaryotes: The Unseen Majority, Proc. Natl. Acad. Sci. USA, Jun. 1998, vol. 95: pp. 6578-6583.

Zhang, N. et al., Microorganisms in the gut of beetles: evidence from molecular cloning, Journal of Invertebrate Pathology 2003, 84: 226-233.

Cupples, AM, et al., DNA buoyant density shifts during 15N-DNA stable isotope probing, Microbiol. Research 2006, 162: 328-334.

Pett-Ridge, J., et al., Microarrays + NanoSIMS: Linking microbial identity and function—LDRD quadchart ER project, Jun. 5, 2006.

Pett-Ridge, J. et al., Microarrays + NanoSIMS: Linking microbial identity and function—LDRD quadchart presentation, Mar. 10, 2006.

Profiling Microbial Identity and Activity: Novel Applications of NanoSIMS and High Density Microarrays—Doe Gtl grant proposal, Mar. 20, 2007.

Pett-Ridge, J., et al., Microarrays + NanoSIMS: Linking microbial identity and function—GtL workshop poster 2007, Feb. 20, 2007.

Pett-Ridge, J., et al., Microarrays + NanoSIMS: Linking microbial identity and function—Gordon Conference poster 2007, Jul. 19, 2007.

Pett-Ridge, J., et al., Microarrays + NanoSIMS: Linking microbial identity and function—ASM poster 2008, Jun. 9, 2008.

Hoeprich, P. et al., Synthesis of DNA Microarrays on Indium—Tin Oxide Surfaces Functionalized with Organophosphonate Monolayers and Organosilanes Enable Analysis by Secondary Ion Mass Spectrometry—ITO array surface peer-review paper.

Loy, A. et al. probeBase—an online resource for rRNA-targeted oligonucleotide probes: new features 2007, Nucleic Acids Research 2007, 35: doi: 10.1093/nar/gkl856, D800-D804.

Suh, S.O. et al. The beetle gut: a hyperdiverse source of novel yeasts, Mycolog. Res. 2005, vol. 109, pp. 261-265.

(56) References Cited

OTHER PUBLICATIONS

Moses, S. et al., Detection of DNA hybridization on indium tim oxide surfaces, Science Direct, Sensors and Actuators B 125 (2007), pp. 574-580.
Bao, P. et al. High Sensitivity Detection of DNA Hybridization on Microarrays Using Resonance Light Scattering, Anal. Chem. 2002, vol. 74, pp. 1792-1797.
Brown, P.O. et al., Exploring the new world of the genome with DNA microarrays, Nature Genetics Supplement, Jan. 1999, vol. 21, pp. 33-37.
Brewer, S.H. et al., Formation of Thiolate and Phosphonate Adlayers on Indium—Tin Oxide: Optical and Electronic Characterization, Langmuir, 2002, vol. 18, pp. 6857-6865.
Keena, M.A., A pourable artificial diet for rearing *Anoplophora glabripennis* (Coleoptera: Cerambycidae) and methods to optimize larval survival and synchronize development. Ann. Entomol. Soc. Am. 2005, vol. 98, pp. 536-547.
Chen, Y. et al., DNA stable isotope probing, Stable isotope probing and related technologies, ASM Press, Washington D.C., 2010.
Finzi, J.A. et al., Chapter 4: Temporal segregation of CO2 and N2 Fixation in Trichodesmium IMS-101 using Nanometer-Resolution Secondary Ion Mass Spectrometry (NanoSIMS), Aug. 2007.
National Research Council of the National Academies. 2006. Review of the Department of Energy's Genomics: GTL Program. The National Academies Press, Washington D.C.
Orphan, V.J. et al., Multiple archeal groups mediate methane oxidation in anoxic seep sediments, PNAS, 2002, vol. 99, pp. 7663-7668.
Flanagan, J.L. et al., Loss of Bacterial Diversity during Antibiotic Treatment of Intubated Patients Colonized with *Pseudomonas aeruginosa*, Journal of Clinical Microbiology, Jun. 2007, vol. 45, No. 6, pp. 1954-1962.
Reiman, D.A. The human body as microbial observatory, Nature Genetics, 2002, vol. 30, pp. 131-133.
Brinig, M. et al., Prevalence of bacteria of division TM7 in human subgingival plaque and their association with disease, Applied and Environmental Microbiology, 2003, 69(3), pp. 1687-1694.
Ouverney, C.C. et al., Single-Cell Enumeration of an Uncultivated TM7 Subgroup in the Human Subgingival Crevice, Applied and Environmental Microbiology, Oct. 2003, vol. 69, No. 10, pp. 6294-6298.
Non-Final Office Action issued for U.S. Appl. No. 12/366,476 in the name of Lawrence Livermore National Security, LLC, mail date: Apr. 23, 2012.
Non-Final Office Action issued for U.S. Appl. No. 12/366,476 in the name of Lawrence Livermore National Security, LLC, mail date: Nov. 15, 2011.
Restriction Requirement issued for U.S. Appl. No. 12/366,476 in the name of Lawrence Livermore National Security, LLC, mail date: Sep. 23, 2011.
Blackwell, M., et al., Fungi in the hidden environment: the gut of beetles, 2007, pp. 357-370, In: British Mycological Symposia: Fungi in the environment. Ed. Geoffrey Gadd. Cambridge Univ. Press.
Mayali, X. et al., Isotopic analysis of RNA microarrays shows microbial resource use profiles decoupled from phylogeny—Chip-SIP proof of concept peer-review paper (Published as Mayali, X. et al. "High-throughput isotopic analysis of RNA microarrays to quantify microbial resource use." The ISME Journal, 1-12, Dec. 8, 2011).
Mayali, X. et al., Chip-SIP for simultaneous analysis of 15N and 13C substrate incorporation by microbial taxa—Chip-SIP methodology peer-review paper (Published as Mayali, X. et al. "High-throughput isotopic analysis of RNA microarrays to quantify microbial resource use." The ISME Journal, 1-12, Dec. 8, 2011).
Mayali, X. et al. High-throughput isotopic analysis of RNA microarrays to quantify microbial resource use. The ISME Journal, 1-12, Dec. 8, 2011.
Definition of "system" retrieved from Oxford Dictionaries Online (http://www.oxforddictionaries.com/definition/system?view=uk) on Dec. 16, 2010.
International Search Report for PCT/US2009/033193 filed on Feb. 5, 2009 in the name of Lawrence Livermore National Security, LLC.
Written Opinion for PCT/US2009/033193 filed on Feb. 5, 2009 in the name of Lawrence Livermore National Security, LLC.
Brodie, E., et al., Urban aerosols harbor diverse and dynamic bacterial populations, PNAS 2007, 104: 299-304.
DeSantis, T., et al., High-density universal 16S rRNA microarray analysis reveals broader diversity than typical clone library when sampling the environment, Microbial Ecology 2007, 53: 371-383.
Lechene, C., et al., High-resolution quantitative imaging of mammalian and bacterial cells using stable isotope mass spectrometry, Journal of Biology 2006, 5: 20-49.
Stadermann, R., et al., Nanosims: the next generation ion probe for the microanalysis of extraterrestrial material, Meteoritics & Planetary Science 1999, 34: A111.
Gardner, T.J., et al. Systems for Orthogonal Self-Assembly of Electroactive Monolayers Onau and Ito: An Approach to Molecular Electronics, Journal of the American Chemical Society 1995, 117: 6927-6933.
Brodie, E., et al. Profiling Microbial Identity and Activity: Novel Applications of NanoSIMS and High Density Microarrays. Feb. 13, 2008.
G.H. McGall et al. "The Efficiency of Light-Directed Synthesis of DNA Arrays on Glass Substrates," J. Amer. Che. Soc. 1997, 119: 5081-5090.
M.A. Schena et al. "Quantitative Monitoring of Gene Expression Patterns with a Complementary DNA Microarray," Science, 1995, 270: 467-470.
M. Curreli et al. "Selective Functionalization of In2O3 Nanowire Mat Devices for Biosensing Applications," JACS 2005, 127: 6922-6923.
S. Koh et al. "Phenylphosphonic Acid Functionalization of Indium Tin Oxide: Surface Chemistry and Work Functions," J. Amer. Che. Soc. 2006, 22:6249-6255.
E. Moore et al. "Surface characterization of indium—tin oxide thin electrode films for use as a conducting substrate in DNA sensor development," Thin Solid Films, 2006, xx:xxx-xxx.
Y. Zhou et al. "Potentiometric Sensing of Chemical Warfare Agents: Surface Imprinted Polymer Integrated with an Indium Tin Oxide Electrode," Anal. Chem. 2004, 76:2689-2693.
S.H. Park et al. "A spatially resolved nucleic acid biochip based on a gradient of density of immobilized probe oligonucleotide," Analytica Chimica Acta, 2006, 564:133-140.
N.D. Popovich et al. "Electrochemical sensor for detection of unmodified nucleic acids," Talanta, 2002, 56:821-828.
Overview of Genechip Technology (retrieved on Jan. 14, 2009). Retrieved from the internet: http://www.ohsu.edu/gmsr/amc/amc_technology.html.
GeneChip Overview Flowchart (retrieved on Jan. 14, 2009). Retrieved from the internet: http://www.ohsu.edu/gmsr/amc/tech_images/chip_overview_pic.html.
Aoyagi, S., An orientation analysis method for protein immobilized on quantum dot particles, Applied Surface Science 2009, 256: 995-997.
Barison, S., et al., An investigation of cobalt oxide based nanocrystalline thin films by secondary ion mass spectrometry, Rapid Communications in Mass Spectrometry 2001, 15: 1621-1624.
Chia, W., et al., Improved optical transmittance and crystal characteristics of ZnS:TbOF thin film on Bi4Ti3O12/indium tin oxide/glass substrate by using a SiO2 buffer layer, Japanese Journal of applied Physics Part 1—Regular Papers Brief Communications & Review Papers 2006, 47: 5847-5852.
Chiou, B., et al., Effect of reactive ion etching and post-etching annealing on the electrical characteristics of indium—tin oxide silicon junctions. Journal of Materials Science—Materials in Electronics 1998, 9: 151-157.
Choi, N., et al., Novel surface modification of indium—tin—oxide films using ion implantation for organic light-emitting diodes, Japanese Journal of Applied Physics Part 1—Regular Papers Short Notes & Review Papers 2004, 43: 5516-5519.
Christensen, J., et al., Analysis of thin layers and interfaces in ITO/a-Si: H/c-Si heterojunction solar cell structures by secondary ion mass spectrometry, Thin Solid Films 2006, 511: 93-97.
Decker, F., et al., Li+ distribution into V2O5 films resulting from electrochemical intercalation reactions, Journal of the Brazilian Chemical Society 2008, 19: 667-671.

(56) References Cited

OTHER PUBLICATIONS

Jeong, J., et al., Electrostatic bonding of silicon-to-ITO coated #7059 glass using Li-doped oxide interlayer, Journal of the Korean Physical Society 1998, 33: S406-S410.

Lee, H., et al., Creating advanced multifunctional biosensors with surface enzymatic transformations, Langmuir 2006, 22: 5241-5250.

Lee, H., et al., Surface enzymes kinetics for biopolymer microarrays: a combination of Langmuir and Michaelis-Menten concepts, Langmuir 2005, 21: 4050-4057.

Kim, T., et al., The effect of buffer layer on the structural and electrical-properties of (BaSr)TiO3 thin films . . . , Journal of Applied Physics 1994, 76: 4316-4322.

Kim, T., et al., Influences of indium tin oxide layer on the properties of RF magnetron-sputtered (BaSr)TiO3 thin-films on indium tin oxide-coated glass substrate, Japanese Journal of Applied Physics Part 1—Regular Papers Short Notes & Review Papers 1993, 32: 2837-2841.

Lee, J., et al., Effect of barrier layers on the properties of indium tin oxide thin films on soda lime glass substrate, Thin Solid Films 2009, 517: 4074-4077.

Sauer, G., et al., Characterization of polymeric light-emitting-diodes by sims depth profiling analysis, Fresenius Journal of Analytical Chemistry 1995, 353: 642-646.

Shah, S., et al., Micropatterning of proteins and mammalian cells on indium tin oxide, ACS Applied Materials & Interfaces 2009, 1: 2592-2601.

Shah, S.S. et al., Exercising spatiotemporal control of cell attachment with optically transparent microelectrodes, Langmiur 2008, vol. 24, pp. 6837-6844.

Song, J., et al., Application of nano-cluster ion beam to surface smothering, etching, and ultra-shallow junction formation, Journal of the Korean Physical Society 2003, 42: S606-S610.

Sun, Y., et al., Label-free detection of biomolecules on microarrays using surface-colloid interaction, Analytical Biochemistry 2007, 361: 244-252.

Tang, C., et al., Adsorption and electrically stimulated desorption of triblock copolymer poly(propylene sulfideblethylene glycol) (PPS-PEG) from indium tin oxide (ITO) surface, Surface Science 2006, 600: 1510-1517.

Vaidya, A., et al., DNA attachment chemistry at the flexible silicone elastomer surface: Toward disposable microarrays, Langmuir 2004, 20: 11100-11107.

Wu, K. et al., Effects of ITO thin films on microstructural and photocatalytic properties of layered TiO2/ ITO films prepared via an extended deposition period, Applied Catalysis B-Environmental 2009, vol. 92, pp. 357-366.

Zhang, K., et al., Indium tin oxide films prepared by radio frequency magnetron sputtering method at a low processing temperature, Thin Solid Films 2000, vol. 376, pp. 255-263.

Wagner, M., et al., Linking microbial community structure with function: fluorescence in situ hybridization-microautoradiography and isotope arrays, Current Opinions in Biotechnology 2006, 17: 83-91.

Anderson, BJ, et al., Secondary ion mass spectrometry with a 50 nm spatial resolution applied to neural tissue. 2006 Neuroscience Meeting Planner, Atlanta: Society for Neuroscience 2006.

Boschker, H. et al., The contribution of macrophyte-derived organic matter to microbial biomass in salt-marsh sediments: stable carbon isotope analysis of microbial biomarkers, Limnology and Oceanography 1998, vol. 44(2), pp. 309-319.

Boschker, H., et al., Stable isotopes and biomarkers in microbial ecology, FEMS Microbiology Ecology 2002, 40: 85-95.

Brodie, E., et al., Bacterial community dynamics across a floristic gradient in a temperate upland grassland ecosystem, Microbial Ecology 2002, 44: 260-270.

Brodie, E., et al., Spatial characterization of the prokaryotic community structure in passalid beetle gut using a high-density 16S rRna PhyloChip, ASM General Meeting 2007b, Orlando, FL.

Breznak, J.,et al., Role of microorganisms in the digestion of lignocellulouse by termites, Annual Review of Entomology 1994, 39: 453-487.

Bryant, MP, et al., Growth of *Desulfovibrio* in lactate or ethanol media low in sulfate in association with H2-utilizing methanogenic bacteria, Appl. Environ. Microbiol. 1977, 33: 1162-1169.

Buckley, D., et al., Stable Isotope Probing with 15N Achieved by Disentangling the Effects of Genome G+C Content and Isotope Enrichment on DNA Density, Appl. Environ. Microbiol., May 2007a, vol. 73, No. 10, pp. 3189-3195.

Buckley, D., et al., Stable isotope probing with 15N2 reveals novel non-cultivated diazotrophs in soil, Appl. Environ. Microbiol., 2007b.

* cited by examiner

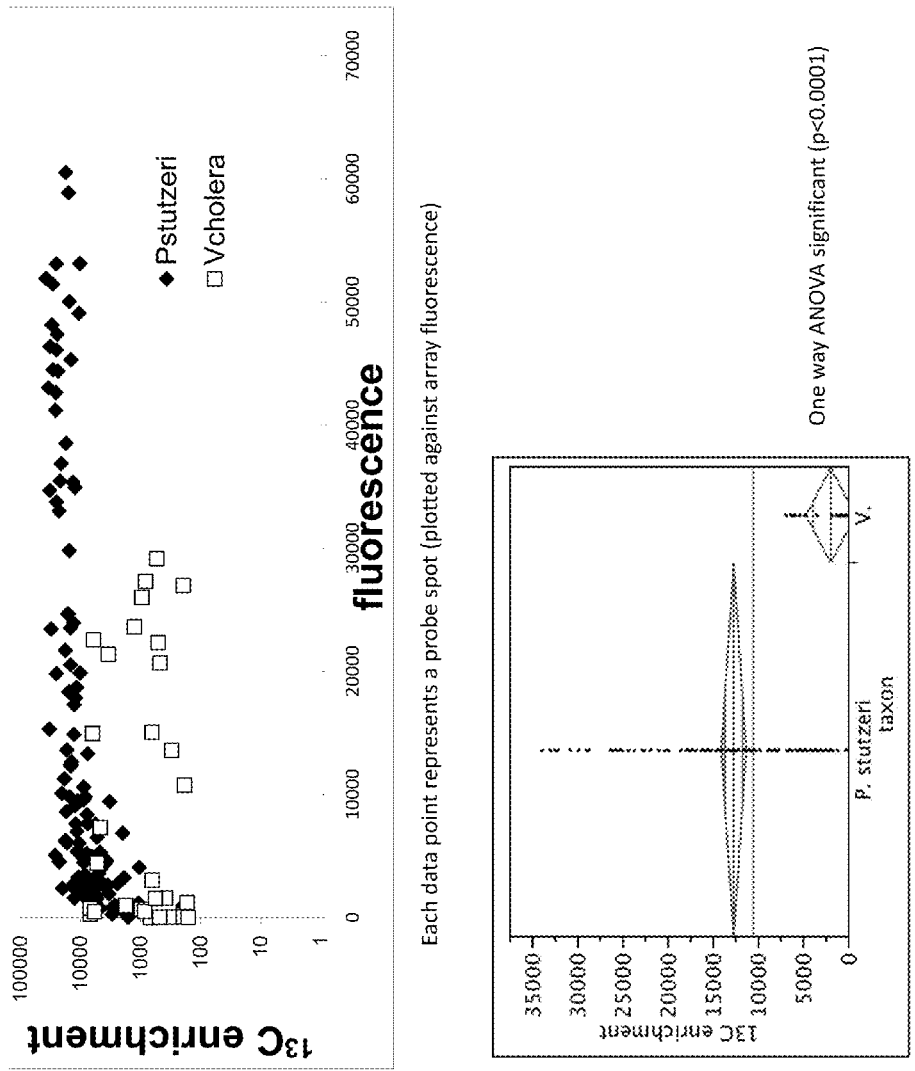

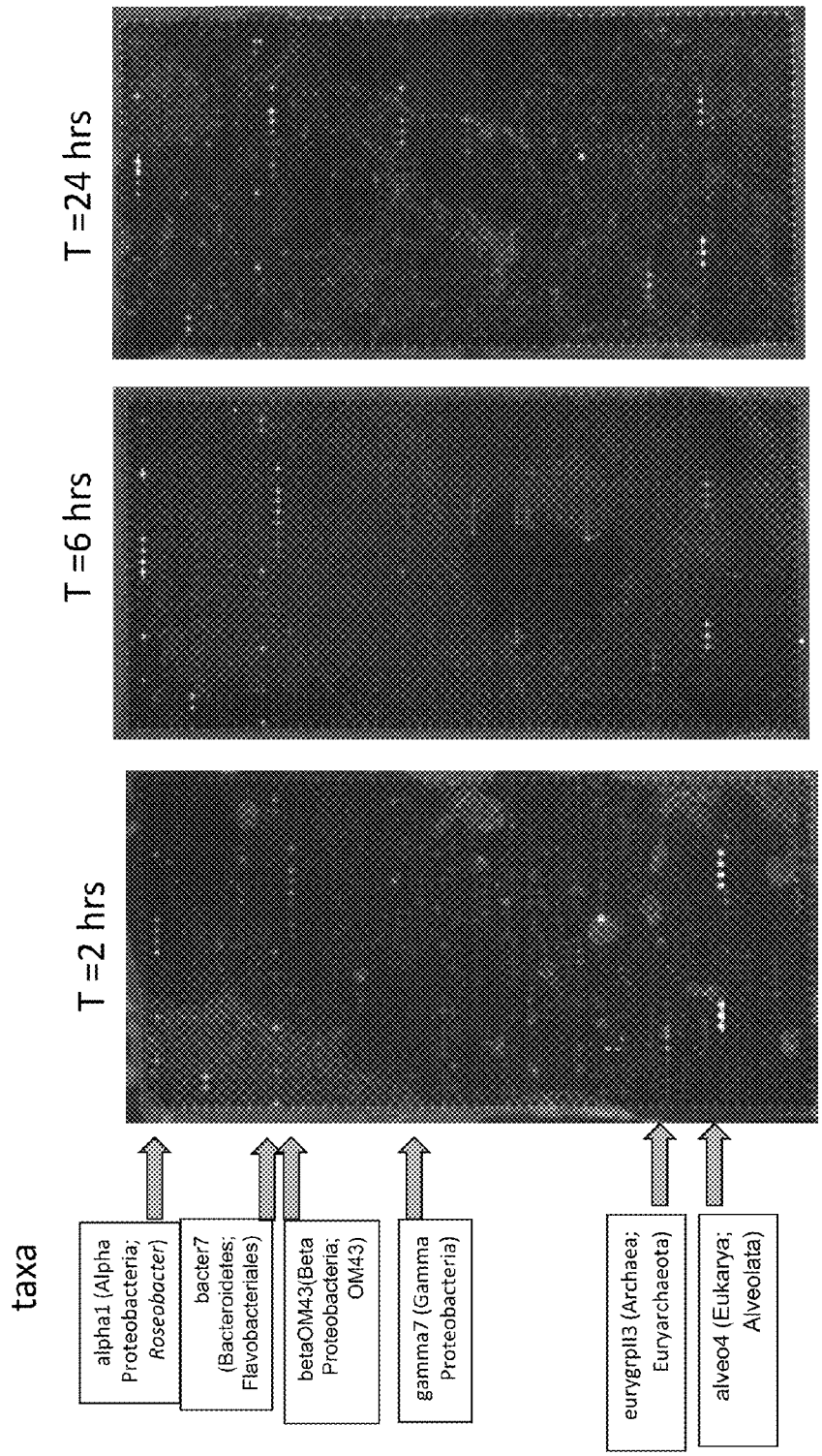

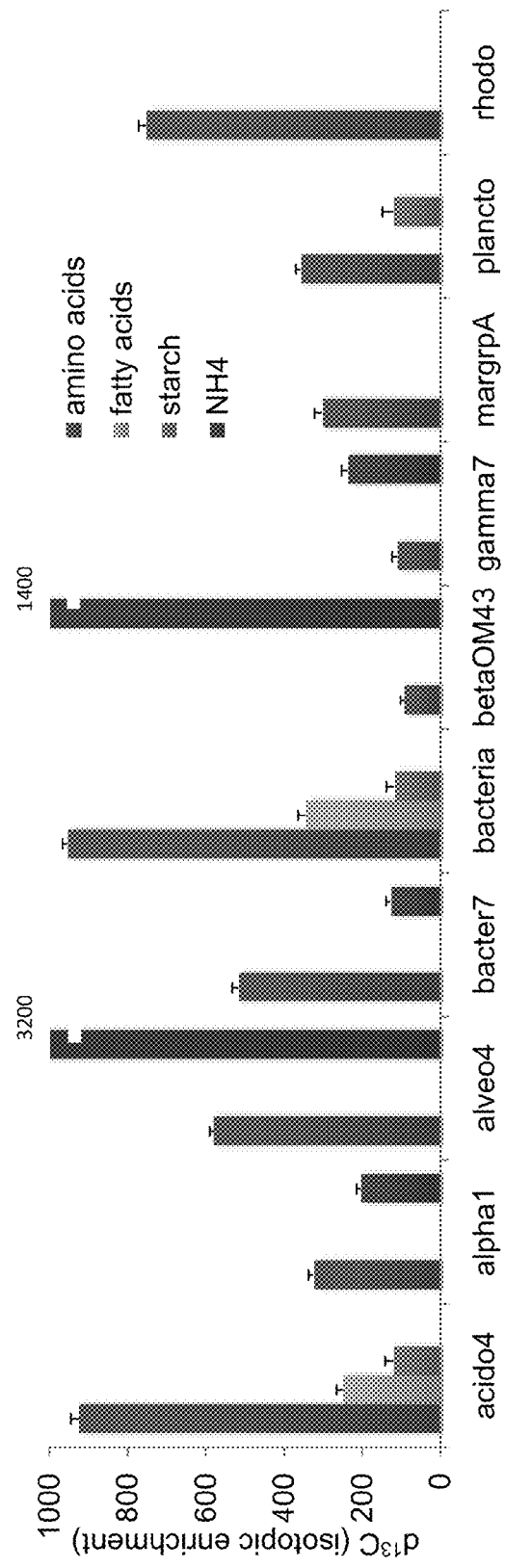

USING PHYLOGENETIC PROBES FOR QUANTIFICATION OF STABLE ISOTOPE LABELING AND MICROBIAL COMMUNITY ANALYSIS

CROSS-REFERENCE TO RELATED APPLICATIONS

This application claims priority to U.S. Provisional Patent Application No. 61/302,535, filed on Feb. 8, 2010 and to U.S. Provisional Patent Application No. 61/302,827 filed on Feb. 9, 2010, both of which are hereby incorporated by reference. This application is related to concurrently filed U.S. patent application Ser. No. 13/023,468, filed on Feb. 8, 2011, entitled "Devices, Methods and Systems for Targeted Detection," which claims priority to these same U.S. Provisional Patent applications and is hereby incorporated by reference in its entirety.

STATEMENT OF GOVERNMENTAL SUPPORT

This invention was made in part by the US DOE Office of Biological and Environmental Research Genomic Sciences research program and the LLNL Laboratory Directed Research and Development (LDRD) program with government support under Contract No. DE-AC02-05CH11231 and under Contract DE-AC52-07NA27344 awarded by the U.S. Department of Energy. The government has certain rights in the invention.

REFERENCE TO SEQUENCE LISTING AND TABLES

This application hereby incorporates the attached sequence listing in computer readable form and the attached Table 1 showing the sequences SEQ ID NOS:1-2805.

BACKGROUND OF THE INVENTION

1. Field of the Invention

The present invention relates to methods of using probes and microarrays to measure multiple different stable isotopes in nucleic acids and identification and analysis of microbial communities.

2. Related Art

Identification of microorganisms responsible for specific metabolic processes remains a major challenge in environmental microbiology, one that requires the integration of multiple techniques.

Nucleic acid stable isotope probing (SIP) techniques (5, 6) are currently the most widely used means to directly connect specific substrate utilization to microbial identity, a grand challenge in the field of microbial ecology (7). For traditional SIP, natural microbial communities are incubated in the presence of a substrate enriched in a rare stable isotope (either $^{13}C$ or $^{15}N$). The organisms, including their nucleic acids, incorporate the substrate and become isotopically enriched over time. Ultracentrifugation is used to separate isotopically enriched nucleic acids from lighter, unenriched nucleic acids for molecular analysis. In the past decade, these approaches have generated many advances in the understanding of microbial bioremediation, plant-microbe interactions and food web dynamics (8), yet they remain hindered by logistical drawbacks (9). These issues are intensified when working with density-gradient centrifugation of RNA, where the focus is on active organisms that are not necessarily replicating. Most notably, traditional DNA- and RNA-SIP isotope exposure risks fertilization effects by requiring high substrate concentrations in order to meet the sensitivity threshold of density gradient separation (in many systems>20% $^{13}C$ DNA) (10) and is extremely difficult to perform with $^{15}N$ labeled substrates (>40% $^{15}N$ DNA required) (11). Other disadvantages include long exposure times (risking community cross-feeding), low-throughput (1-2 weeks lab processing time per sample batch), and incomplete quantification. Though related culture-independent approaches also have ideal qualities such as high sensitivity or in situ resolution (e.g. $^{13}C$-PLFA (12); EL FISH (13), FISH MAR (14), isotope arrays (15)), none combines high throughput, sensitivity, taxonomic resolution, and quantitative estimates of multiple stable isotope ($^{15}N$ and $^{13}C$) incorporation.

BRIEF SUMMARY OF THE INVENTION

The present invention provides a method for quantification of stable isotope labeling using phylogenetic probes.

In another aspect, the present invention comprises community analysis using such phylogenetic probes.

The methods described have the ability to track the update of carbon, nitrogen and oxygen in ribonucleic acids and providing insight into how microorganisms metabolize these elements. The methods as described can track the uptake of carbon and nitrogen simultaneously and also be applied to oxygen. There is no other known method that can track the uptake of carbon and nitrogen simultaneously.

A method for determination of stable isotope incorporation in a organism or a community of organisms comprising the steps of: (a) supplying an organism or said community of organisms with a stable isotope labeled substrate for a defined period of time; (b) extracting RNA from the organisms; (c) fragmenting said RNA; (d) labeling a fraction the fragmented RNA with a detectable label; (e) hybridizing the labeled RNA to a set of oligonucleotide probes; (f) detecting hybridization signal strength of labeled RNA hybridized to any of the oligonucleotide probes and identifying and selecting the hybridized oligonucleotide probes as a responsive set of probes; (g) hybridizing a fraction of unlabeled RNA to a second set of oligonucleotide probes comprising the responsive set of probes; (h) detecting the unlabeled RNA hybridized to the responsive set of probes to determine the stable isotope incorporation into the organism using spectrometry or spectroscopy.

In one embodiment, the organism is a bacterium, archaea, fungi, plant, arthropod, or nematode, or other eukaryote. In a specific embodiment, the organism is a bacterium.

In one embodiment, the stable-isotope labeled substrate is $^3H$, $^{13}C$ $^{15}N$, and/or $^{18}O$.

Extraction of RNA can be carried out by physical and/or chemical cell lysis and affinity column purification. Fragmentation is generally carried out by using either enzymes or chemicals or heat or a combination of these. A fraction or aliquot of the RNA is then labeled with a fluorescent molecule or a non-fluorescent molecule. Fragmentation and labeling can occur in some embodiments concurrently.

In one embodiment, the set of oligonucleotide probes comprising an array of oligonucleotide probes attached to a substrate such as a microarray or chip. The labeled fragmented RNA can then be added to a hybridization solution and the hybridization solution contacted to the array of oligonucleotide probes to allow the labeled RNA to hybridize to the probes.

In one embodiment, the set of oligonucleotide probes comprising 16S rRNA phylogenetic oligonucleotide probes. The set of 16S rRNA phylogenetic probes further comprising probes from the 16S rRNA gene, 23S rRNA gene, 5S rRNA gene, 5.8S rRNA gene, 12S rRNA gene, 18S rRNA gene, 28S rRNA gene, gyrB gene, rpoB gene, fusA gene, recA gene, cox1 gene, nif13 gene, RNA molecules derived therefrom, or a combination thereof.

The array with the hybridized labeled RNA is imaged with a fluorescence scanner and fluorescence intensity measured for each probe feature and the detection of hybridization signal strength provides a determination of the genes present in a organism or genes and/or organisms present in the community of organisms. The detection of hybridization signal strength also provides a means for normalization of the isotope signals detected.

In one embodiment, the probes that hybridized to the labeled RNA are synthesized onto a second array of oligonucleotide probes comprising down-selected probes or responsive probes. The unlabeled RNA is hybridized to the second array hybridized unlabeled RNA are imaged with a with a secondary ion mass spectrometer and isotope ratios are measured for each probe feature.

The presently described methods provide high throughput, sensitivity, taxonomic resolution, and quantitative estimates of multiple stable isotope ($^{15}$N and $^{13}$C) incorporation. In one embodiment, microbial identity and function are connected by isolating rRNA from individual taxa through hybridization to phylogenetic probes. In one embodiment, the probes are displayed on a substrate surface, such as a custom glass microarray. After hybridization, these probe features are then analyzed for isotope enrichment. In some embodiments, the probes are analyzed using analysis techniques including but not limited to, spectrometry, spectroscopy, and quantitative secondary ion mass spectrometry imaging.

Direct NanoSIMS analysis is made possible by implementing a new surface chemistry for synthesis of DNA on conductive material. With this approach, thousands of unique phylogenetic probes assaying hundreds of taxa can be quickly analyzed from a single sample.

The present methods may be used in applications such as the evaluation of how certain organisms metabolize cellulose and what enzymes they use to do this; evaluation of what organisms have the ability to degrade pollutants in an environmental sample such as oil using water samples from the recent Gulf oil spill; or a study of carbon sequestration.

BRIEF DESCRIPTION OF THE DRAWINGS

FIG. 1: (A) fluorescence image and (B) NanoSIMS isotopic enrichment image montage of a microarray hybridized with RNA from a single bacterial strain (*Pseudomonas stutzeri*) grown on $^{13}$C glucose.

FIG. 4B shows a graph of the fluorescence intensity and $^{13}$C enrichment for *Pseudomonas stutzeri* grown on 100% $^{13}$C glucose, *Vibrio cholera* grown on 20% $^{13}$C glucose (images are not shown). A graph on the bottom panel shows one-way ANOVA analysis which demonstrates that the method is semi-quantitative because one taxa is more enriched than the other.

FIG. 5. San Francisco Bay water collected at Berkeley pier, incubated with 200 uM $^{15}$N ammonium for 24 hours. FIG. 5A shows array images of a marine microbes array designed using ARB (Ludwig, W., Strunk, O., Westram, R., Richter, L., Meier, H., Yadhukumar et al. 2004. Nucl. Acids Res. 32:1363-1371); each row represents a different taxon.

FIG. 6 is a graph showing the $^{13}$C enrichment in various taxa after incubation. San Francisco Bay water collected at Berkeley pier, incubated with 50 μM $^{13}$C amino acids (98% $^{13}$C), 30 μM fatty acids (98% $^{13}$C), and 10 mg L-1 starch (10% $^{13}$C) for 12 hours. Additional probes for larger phylogenetic groups (bacteria, Rhodobacteriacea, Planctomycetes, Marine Group A) designed using ARB.

DETAILED DESCRIPTION

Initial experiments utilized a single bacterial strain (*Pseudomonas stutzeri*) grown on $^{13}C$ glucose as the sole carbon source to determine the feasibility of successful hybridization of extracted RNA on the microarray surface, and detection of $^{13}C$ from the hybridized RNA. FIG. 1 shows images of arrays of hybridization of extracted RNA from a single bacterial species (*Pseudomonas stutzeri*) grown on $^{13}C$-glucose as the sole carbon source. Each spot (and data point) represents a distinct probe specific for *Pseudomonas*. The results show fluorescence (a measure of how much RNA is hybridized) and $^{13}C$ enrichment are positively correlated, demonstrating successful detection of labeled RNA with the Phylochip probe array.

Figure 3:
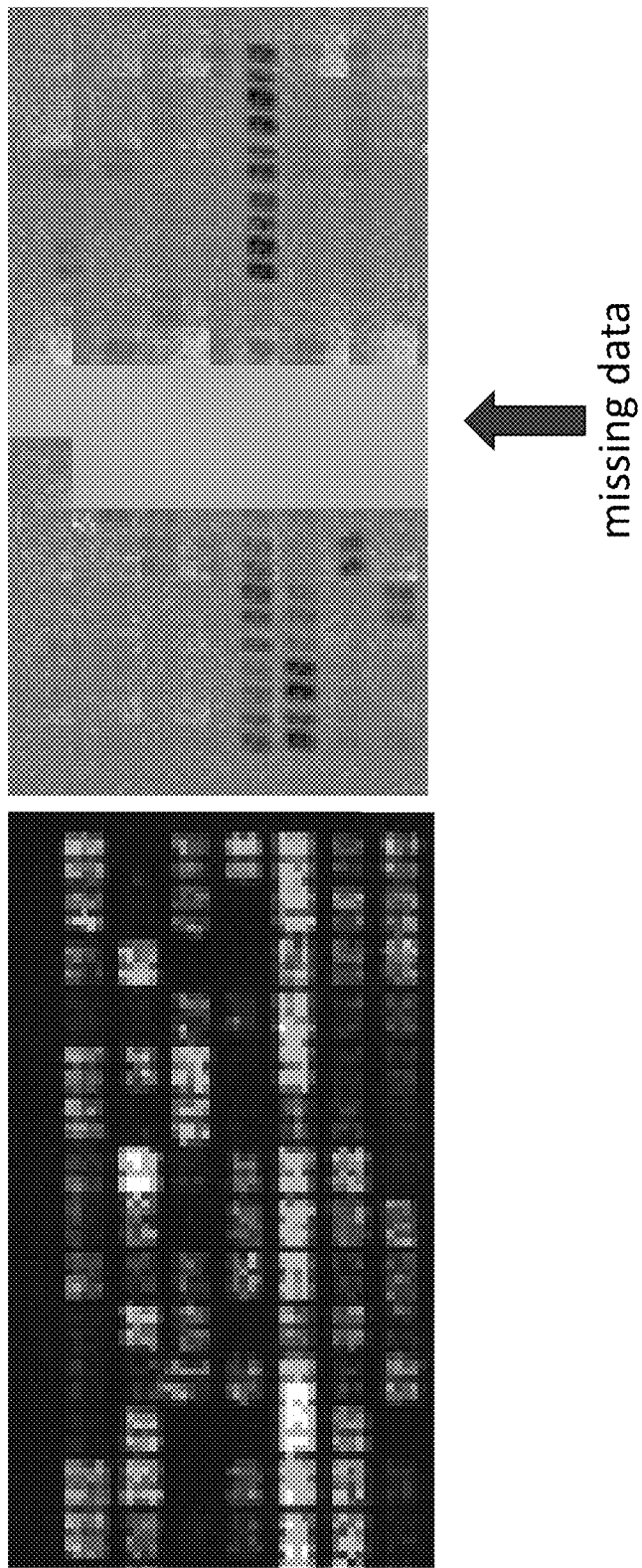
FIG. 3 shows two array images of RNA enriched with 0.5% $^{13}$C successfully detected by phylogenetic probes.

Referring now to FIG. 3, the limits of prior detection methods of isotopic enrichment are not seen using the present probes and using such analysis methods as nanoSIMS (nanoscale secondary ion mass spectrometry). Traditional SIP (Stable Isotope Probing) requires approximately 10 atom % isotopic enrichment for detection (Radajewski S, Ineson P, Parekh N R & Murrell J C 2000. *Nature* 403: 646-649). We have successfully detected hybridized RNA from *Pseudomonas stutzeri* grown in 0.5 atom % $^{13}C$ glucose. RNA enriched with 0.5% $^{13}C$ successfully detected.

Figure 4A:
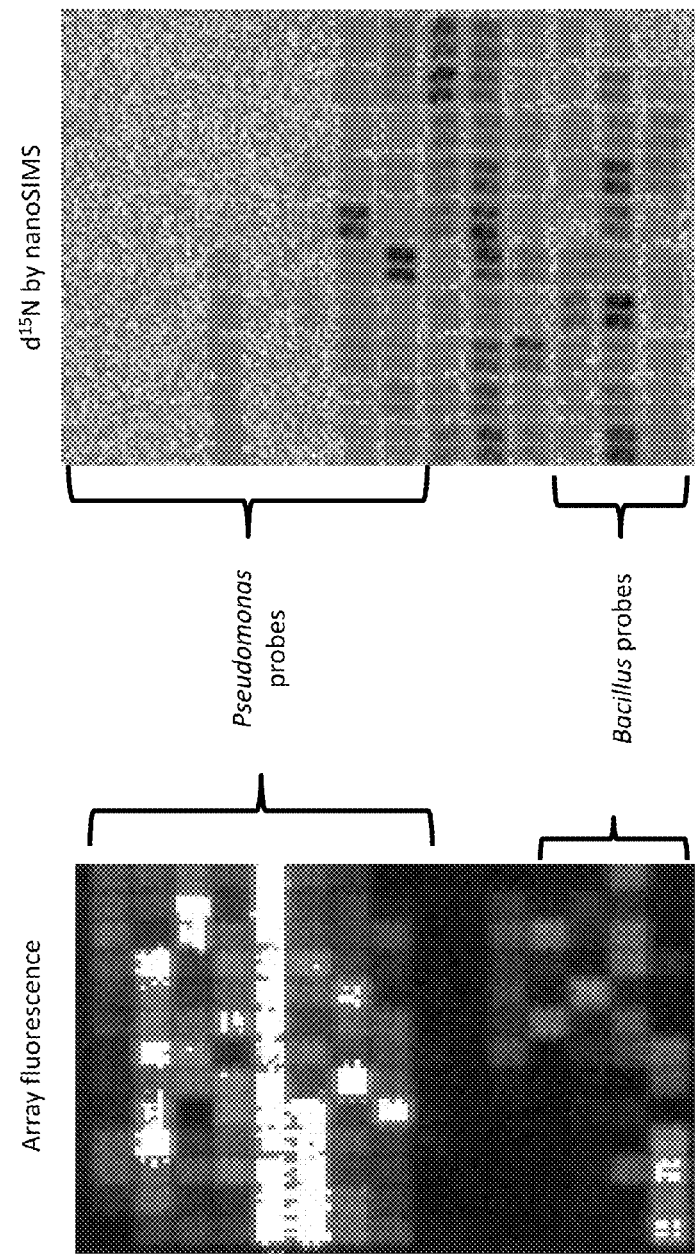
FIG. 4A shows two array images of *Pseudomonas stutzeri* grown on 25% $^{15}$N ammonium, *Bacillus cereus* grown on natural abundance ammonium; RNA extracted, mixed in equal concentrations, hybridized on array with phylogenetic probes.

FIG. 4 shows results of experiments with artificial mixed communities. Before testing the method in the environment, we mixed RNA from different bacterial strains grown on different levels of $^{13}C$ or $^{15}N$ to determine cross-hybridization potential. An experiment was carried out with a simple two-member community: *Pseudomonas stutzeri* grown on 25% $^{15}N$ ammonium, *Bacillus cereus* grown on natural abundance ammonium; RNA extracted, mixed in equal concentrations, hybridized on array featuring Phylochip probes. Experiment 2: *Pseudomonas stutzeri* grown on 100% $^{13}C$ glucose, *Vibrio cholera* grown on 20% $^{13}C$ glucose (images are not shown). The results of these two experiments shows that unlabeled taxa do not show isotopic signal in NanoSIMS, and that the present method can potentially be semi-quantitative (e.g. one taxon is more enriched than another).

Figure 5B:
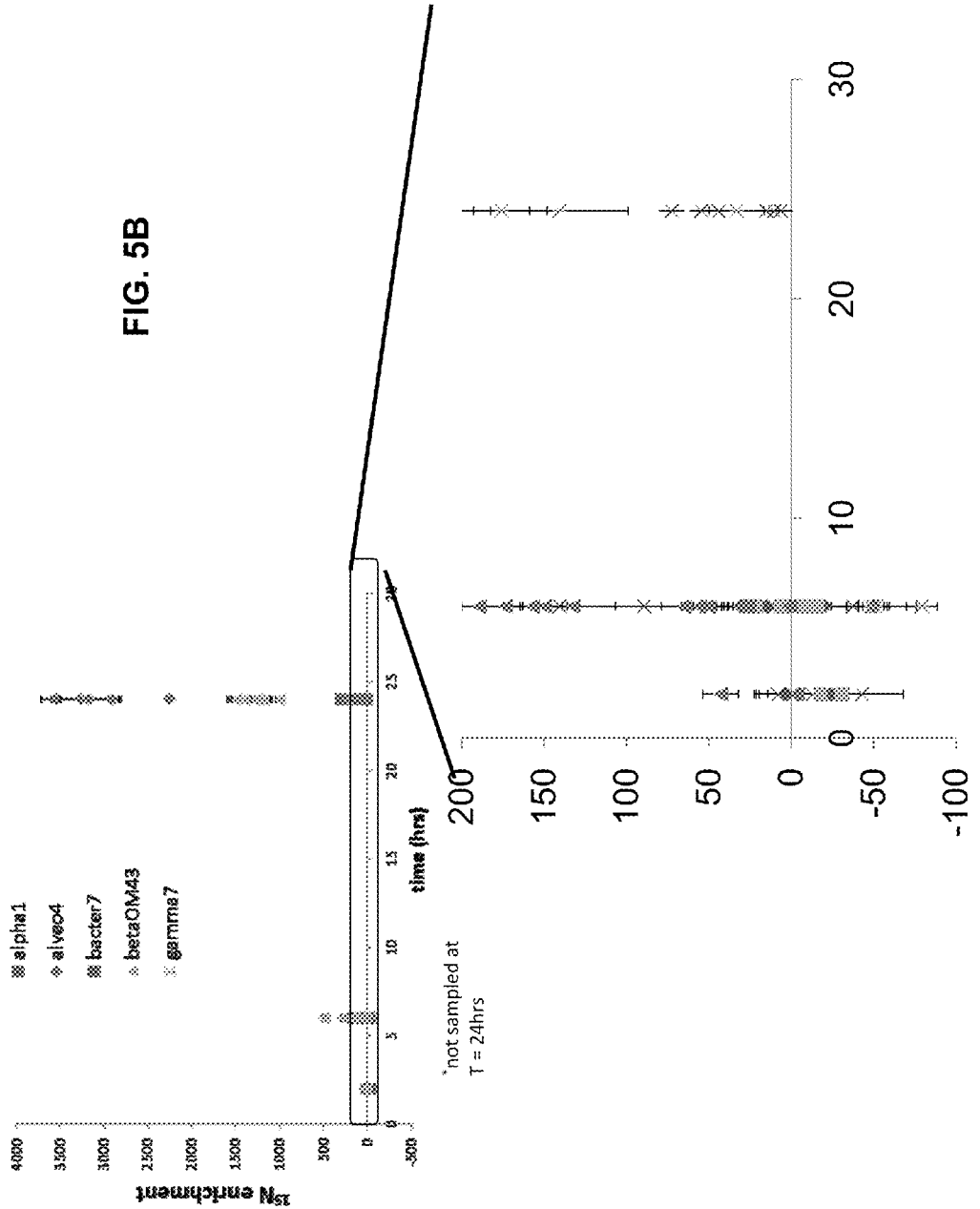
FIG. 5B is a graph showing the $^{15}$N enrichment in various taxa over time.

FIG. 5 shows the first trial of method with natural microbial communities: To apply the method to the environment, we designed a 16S rRNA and 18S rRNA microarray for common marine microbial taxa (bacteria, archaea, and protists) targeting specific phylotypes (approximately at the genus level). Estuarine samples were incubated in the presence of $^{15}N$ ammonium and sampled over time. Application of the present method using the phylogenetic probes to samples collected in San Francisco Bay water collected at Berkeley pier, incubated with 200 uM $^{15}N$ ammonium for 24 hours. Marine microbes array designed using ARB (Ludwig, W., Strunk, O., Westram, R., Richter, L., Meier, H., Yadhukumar et al. 2004. Nucl. Acids Res. 32:1363-1371); each row represents a different taxon. FIGS. 5A and 5B show that different taxa incorporate ammonia at different rates. The microarray probes are found in the accompanying Sequence Listing and identified as SEQ ID NOS:1-2805.

Little is known about organic carbon incorporation patterns in marine and estuarine environments, partly because the dominant organisms are uncultured and cannot be directly interrogated in the laboratory. We used the Chip-SIP method to test whether different taxa incorporate amino acids, fatty acids, and starch for their carbon growth requirements.

FIG. 6 shows the use of Chip-SIP method to identify organic matter utilization in estuarine microbial communities in San Francisco Bay water collected at Berkeley pier. The samples were incubated with 50 μM $^{13}C$ amino acids (98% $^{13}C$), 30 μM fatty acids (98% $^{13}C$), and 10 mg L-1 starch (10% $^{13}C$) for 12 hours. Additional probes for larger phylogenetic groups (bacteria, Rhodobacteriacea, Planctomycetes, Marine Group A) were designed using ARB. As shown in FIG. 6, different microbial taxa incorporated different substrates in situ. All tested substrates were incorporated by some bacteria. One taxon (acido4) appeared to be a generalist, while all other taxa demonstrated some degree of specificity in the substrates that were incorporated into biomass.

Thus, in one embodiment, the present invention provides methods for quantification of stable isotope labeling to observe and measure resource partitioning in microbial communities using phylogenetic probes. In one embodiment, the phylogenetic probes can be designed. In another embodiment, phylogenetic probes previously designed and provided in the previous applications hereby incorporated by reference can be used.

In one embodiment, such a method involves labeling microbial nucleic acids with stable isotope-labeled substrates (e.g., $^{13}C$-amino acids, cellulose or $^{15}NH_4$). Current methods for stable-isotope probing require large quantities of label to be incorporated into nucleic acids prior to density gradient separation (e.g. refs. Radajewski S, Meson P, Parekh N R & Murrell J C 2000. *Nature* 403: 646-649; Manefield M., Whiteley, A. S., Griffiths, R. I. and Bailey, M. J. 2002. *Appl. Environ. Microbiol.* 68:5367-73), however the necessary quantities of labeled substrate often impose a significant disturbance on system energy and metabolite flux. The presently described approach is to capture ribosomal RNA using sequence specific probes targeting 16S rRNA (Brodie, E. L., T. Z. DeSantis, D. C. Joyner, S. M. Baek, J. T. Larsen, G. L. Andersen, T. C. Hazen, P. M. Richardson, D. J. Herman, T. K. Tokunaga, J. M. M. Wan, and M. K. Firestone. 2006. *Appl. Environ. Microbiol.* 72:6288-6298), and the captured RNA is then analyzed for isotope ratios. Microarrays represent the highest-throughput approach for RNA capture; combining this with analysis methods allows isotope ratios to be determined for potentially hundreds of species within complex communities.

In some embodiments, the methods provides for a method comprising steps as the following described process. An organism or multiple organisms, such as a community of organisms, are supplied with a stable-isotope (e.g., $^{3}H$, $^{13}C$, $^{15}N$, $^{18}O$) labeled substrate for a defined period of time. RNA is extracted from the organisms or community organisms using any number of established procedures as is known in the art.

The organism RNA is fragmented using known fragmentation methods including use of enzymes, chemicals or heat or a combination of these. A first fraction or aliquot of fragmented RNA is labeled with a fluorescent molecule or a non-fluorescently labeled molecule such as biotin. This can occur concurrently with fragmentation in some embodiments.

The labeled fraction of fragmented RNA is added to a hybridization solution and hybridized to a microarray slide. Weakly bound RNA can be removed from the microarray surface by washing in solutions of varying stringency. The RNA that is hybridized to the probes are then imaged to detect hybridization signal strength and thereby quantify the labeled RNA to determine the community organism composition and also to correct and normalize the isotope signals in the RNA bound to each probe.

Currently the organism composition and normalization of isotope signal occurs on a different device than the fluorescent detection of hybridization signal strength and measurement of isotope ratio or isotope incorporation. In such a case, the fluorescent detection provides a subset of responsive probes that correlate to the presence of a specific gene and/or an organism in the sample or the community. After this detection, the organisms are identified and a down-selected probe analysis is carried out. New probes to identify an organism can be designed, or the same probes from the larger set of oligonucleotide probes can be used. For example, in some instances, sequence information generated from reverse-transcribed RNA (cDNA) from the same samples is used to select unique regions for probe design. The down-selected set of new or responsive probes is then synthesized and arrayed onto a separate substrate. A reserved fraction of RNA is then hybridized to the down-selected set of probes and imaged whereby the determination of the isotope incorporation into the organism using spectrometry or spectroscopy.

If a separate device to determine the isotope incorporation into the organism is not required, then a separate set of down-selected probes does not need to be made, but the determination made directly on the RNA hybridized to the larger set of probes.

These steps are meant to provide a basic process and one having skill the art should understand that optimizations and variations to the method are contemplated.

Examples of organisms that can be used in the present methods include but are not limited to, prokaryotic and eukaryotic organisms such as bacteria, archaea, fungi, plants, arthropods, nematodes, avians, mammals, and other eukaryotes, or viruses and phage. In one embodiment, the organism, multiple organisms or a community of organisms is bacteria, archaea, fungi, plants, arthropods, or nematodes. For larger organisms, a cell or tissue sample may be obtained and the RNA extracted from the sample.

The RNA extracted from the organisms may be the total RNA including ribosomal, messenger, and transfer RNA or it may be a subset of the total RNA.

The organisms are supplied with amino acids, cellulose or other labeled substrate containing a stable-isotope. Examples of such stable isotopes include but are limited to $^3H$, $^{13}C$, $^{15}N$, and/or $^{18}O$. Examples of such labeled substrate include $^{13}C$-amino acids, cellulose or $^{15}NH_4$ labeled substrate.

The organisms are supplied the labeled substrate for a defined period of time, such as for several minutes, hours or days. In one embodiment, a microbial community is supplied a labeled substrate for a period of 12, 18, or 24 hours.

Extraction of RNA from the organisms are generally carried out using methods known in the art. Examples of RNA extraction methods for microbial communities are provided in the Examples. In one embodiment, physical and/or chemical cell lysis and affinity column purification is used to extract RNA from the organisms or the cell or tissue sample from the organisms.

Fragmentation of the RNA is often carried out using enzymes, chemicals or heat or any combination of these. A fraction or aliquot of the fragmented RNA is labeled with a fluorescent label for suitable detection or with a label having a known binding partner to which a detectable label can be attached. In another embodiment, the fragmented RNA is labeled with a fluorescent molecule such as Alexafluor 546. In some embodiments, the fragmented RNA is labeled with biotin to which a fluorescently labeled streptavidin can be bound.

After labeling a fraction of the RNA, hybridization of the fragmented labeled RNA to a set of oligonucleotide probes is carried out. The set of oligonucleotide probes is typically attached to a solid planar substrate or on a microarray slide. However, it is contemplated that the probes may be attached to spheres, or other beads or other types of substrates. The substrates often made of materials including but not limited to, silicon, glass, metals or semiconductor materials, polymers and plastics. The substrates may be coated with other metals or materials for specific properties. In one embodiment, the substrate is coated with indium tin oxide (ITO) to provide a conductive surface for NanoSIMS analysis. The oligonucleotide probes may be present in other analysis systems, including but not limited to bead or solution multiplex reaction platforms, or across multiple platforms, for example, Affymetrix GeneChip® Arrays, Illumina BeadChip® Arrays, Luminex xMAP® Technology, Agilent Two-Channel Arrays, MAGIChips (Analysis systems of Gel-immobilized Compounds) or the NanoString nCounter Analysis System. The Affymetrix (Santa Clara, Calif., USA) platform DNA arrays can have the oligonucleotide probes (approximately 25 mer) synthesized directly on the glass surface by a photolithography method at an approximate density of 10,000 molecules per $\mu m^2$ (Chee et al., Science (1996) 274:610-614). Spotted DNA arrays use oligonucleotides that are synthesized individually at a predefined concentration and are applied to a chemically activated glass surface.

The oligonucleotide probes are probes generally of lengths that range from a few nucleotides to hundreds of bases in length, but are typically from about 10 mer to 50 mer, about 15 mer to 40 mer, or about 20 mer to about 30 mer in length.

In one embodiment, the oligonucleotide probes is a set of phylogenetic probes. In another embodiment, the phylogenetic probes comprising 16S rRNA phylogenetic probes. In one embodiment, the set of 16S rRNA phylogenetic probes further comprising probes from the 16S rRNA gene, 23S rRNA gene, 5S rRNA gene, 5.8S rRNA gene, 12S rRNA gene, 18S rRNA gene, 28S rRNA gene, gyrB gene, rpoB gene, fusA gene, recA gene, cox1 gene, nif13 gene, RNA molecules derived therefrom, or a combination thereof.

Features of phylogenetic microarrays of the invention include the use of multiple oligonucleotide probes for every known category of prokaryotic organisms for high-confidence detection, and the pairing of at least one mismatch probe for every perfectly matched probe to minimize the effect of nonspecific hybridization. In some embodiments, each perfect match probe corresponds to 1, 2, 3, 4, 5, 6, 7, 8, 9, 10, 11, 12, 13, 14, 15, 16, 17, 18, 19, 20, or more mismatch probes. These and other features, alone or in combination as described herein, make arrays of the invention extremely sensitive, allowing identification of very low levels of microorganisms.

Methods to design and select suitable probes and arrays for Chip-SIP analysis are described in detail in co-pending U.S. patent application Ser. No. 12/474,204, filed on May 28, 2009 published as US-2009-0291858-A1, and co-pending international application having application number PCT/US2010/

040106, filed on Jun. 25, 2010, both of which are incorporated by reference in their entirety for all purposes.

In one embodiment, the 16s rRNA phylogenetic probes are provided on a microarray chip, such as the G2 Phylochip or the G3 Phylochip available from Phylotech, Inc. (Second Genome, Inc., San Francisco, Calif.) and Affymetrix (Santa Clara, Calif.).

Again, the RNA that is hybridized to the probes are then imaged to detect hybridization signal strength and thereby quantify the labeled RNA to determine the community organism composition and also to correct and normalize the isotope signals in the RNA bound to each probe.

In one embodiment, for analysis for microbial composition and normalization of isotope signals, microarrays hybridized with fluorescent/biotin labeled RNA are imaged with a fluorescence scanner and fluorescence intensity measured for each probe feature or "spot". Arrays can be scanned using any suitable scanning device. Non-limiting examples of conventional microarray scanners include GeneChip Scanner 3000 or GeneArray Scanner, (Affymetrix, Santa Clara, Calif.); and ProScan Array (Perkin Elmer, Boston, Mass.); and can be equipped with lasers having resolutions of 10 pm or finer. The scanned image displays can be captured as a pixel image, saved, and analyzed by quantifying the pixel density (intensity) of each spot on the array using image quantification software (e.g., GeneChip Analysis system Analysis Suite, version 5.1 Affymetrix, Santa Clara, Calif.; and ImaGene 6.0, Biodiscovery Inc. Los Angeles, Calif., USA). For each probe, an individual signal value can be obtained through imaging parsing and conversion to xy-coordinates. Intensity summaries for each feature can be created and variance estimations among the pixels comprising a feature can be calculated.

With flow cytometry based detection systems, a representative fraction of microparticles in each sublot of microparticles can be examined. The individual sublots, also known as subsets, can be prepared so that microparticles within a sublot are relatively homogeneous, but differ in at least one distinguishing characteristic from microparticles in any other sublot. Therefore, the sublot to which a microparticle belongs can readily be determined from different sublots using conventional flow cytometry techniques as described in U.S. Pat. No. 6,449,562. Typically, a laser is shined on individual microparticles and at least three known classification parameter values measured: forward light scatter ($C_1$) which generally correlates with size and refractive index; side light scatter ($C_2$) which generally correlates with size; and fluorescent emission in at least one wavelength ($C_3$) which generally results from the presence of fluorochrome incorporated into the labeled target sequence. Because microparticles from different subsets differ in at least one of the above listed classification parameters, and the classification parameters for each subset are known, a microparticle's sublot identity can be verified during flow cytometric analysis of the pool of microparticles in a single assay step and in real-time. For each sublot of microparticles representing a particular probe, the intensity of the hybridization signal can be calculated along with signal variance estimations after performing background subtraction.

In one embodiment, responsive probe-sets are then identified based on a set criteria. See FIG. 4 For example, when using the Phylochip array of probes, the responsive probe sets are identified based on probability of probe intensities originating in the positive or background intensity distributions. High confidence subfamilies identified with expected 98.4% True Positive Rate and 2.4% False Positive Rate. Probes targeting most probable taxa in high confidence subfamilies are ranked based on quality criteria such as the lowest potential for cross-hybridization across network of putatively present taxa and the greatest difference between Perfect Match (PM) and Mismatch (MM) probe intensities. Ranked PM probes plus corresponding MM probes are synthesized onto an array and then hybridized to a reserved fraction of the RNA isolated from the organism or sample.

Various methods of mass spectrometry may be used in addition to detection using the present phylogenetic probes, such as nanoSIMS (nanoscale secondary ion mass spectrometry) or time-of-flight secondary ion mass spectrometry or other methods or means of spectrometry or spectroscopy. In other embodiments, the use of spectroscopic methods that may be employed include Raman spectroscopy or reflectance or absorbance spectroscopy. In one preferred embodiment, for analysis of isotope incorporation into organisms, microarrays hybridized with non-fluorescently labeled RNA are imaged with a secondary ion mass spectrometer, such as a SIMS or NanoSIMS device. In a specific embodiment, the NanoSIMS device is a NimbleGen MAS and the probe array is synthesized onto ITO-coated slides suitable for NanoSIMS analysis.

In some embodiments, sequence information generated from reverse-transcribed RNA (cDNA) from the same samples is used to select unique regions for probe design.

In another embodiment, the array of probes is synthesized on a substrate coated with Indium Tin Oxide (ITO) to provide a conductive surface for NanoSIMS analysis. For example, ranked PM probes plus corresponding MM probes are synthesized using the NimbleGen MAS on ITO-coated slides suitable for NanoSIMS analysis.

Current and future research will focus on the cellulose-degrading and N-fixing microorganisms found in the guts of the passalid beetle *Odontotaenius disjunctus*. This microbial community represents a naturally-selected highly-efficient lignocellulose degrading consortium, including Pichia stipitis, a yeast with high capacity for xylose fermentation (Nardi, J. B., C. M. Bee, L. A. Miller, N. H. Nguyen, S.-O. Suh, and M. Blackwell. 2006. Arthropod Struct. Devel. 35:57-68; Suh, S.-O., J. V. McHugh, D. Pollock, and M. Blackwell. 2005. Mycolog. Res. 109:261-265). RNA from beetles have been analyzed with LBNL's Phylochip (Brodie, E. L., T. Z. DeSantis, D. C. Joyner, S. M. Baek, J. T. Larsen, G. L. Andersen, T. C. Hazen, P. M. Richardson, D. J. Herman, T. K. Tokunaga, J. M. M. Wan, and M. K. Firestone. 2006. *Appl. Environ. Microbiol.* 72:6288-6298) and probes are being chosen for analysis based on signal intensity relative to background.

We have demonstrated the capability of the Chip-SIP method to link phylogenetic identity and biogeochemical function. We have achieved this by incubating natural microbial communities in the presence of isotope-enriched substrates and analyzing rRNA from those communities for isotopic enrichment in a taxon-specific manner using phylogenetic microarrays. This method can be applied to all microbial systems to advance our understanding of the microorganisms involved in the sequestration of soil and marine carbon, the deconstruction of biofuel feedstocks, biodegradation of organic pollutants and bioimmobilization of radionuclides and heavy metals.

In another embodiment, the phylogenetic probes and the present methods can be used by detecting how the labeled isotope is incorporated or expressed in an organism for resource partitioning. Observing what organisms are actively consuming of a labeled substrate can provide for identifying contaminant degraders, organisms metabolizing biofuel feed stocks and soil/marine organic matter, and optimizing or monitoring biostimulation of microbes for bioremediation as further examples.

EXAMPLE 1

Applying a Chip-SIP Method to a Marine Microbial Community

Figure 1A:
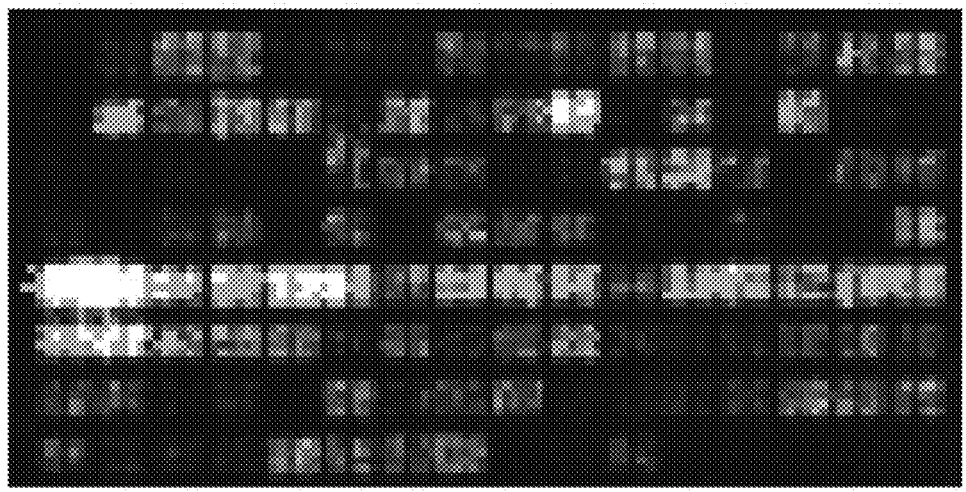
FIGS. 1A and 1B. Hybridization of extracted RNA from a single bacterial species (*Pseudomonas stutzeri*) grown on $^{13}$C-glucose as the sole carbon source. Each spot (and data point) represents a distinct probe specific for *Pseudomonas*.
Figure 1B:
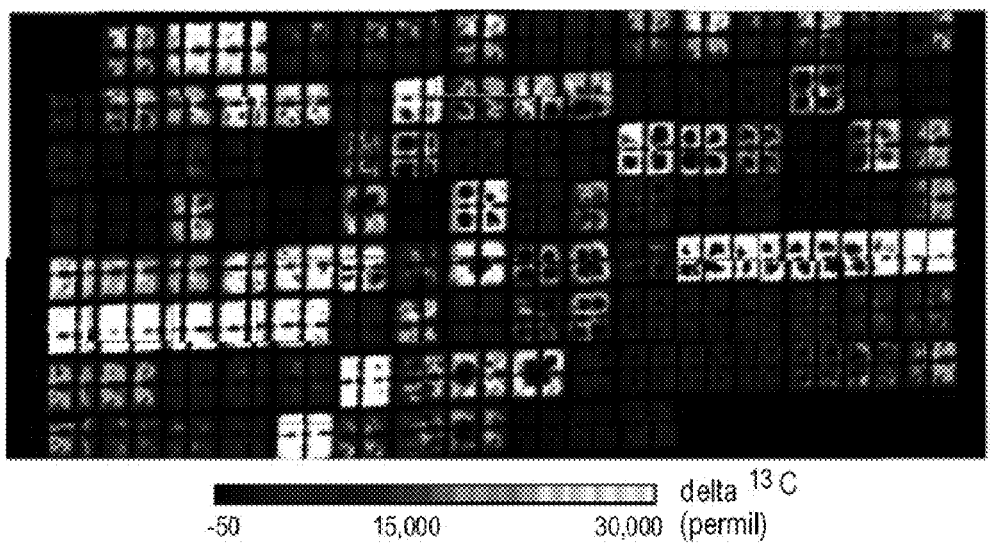
Figure 9:
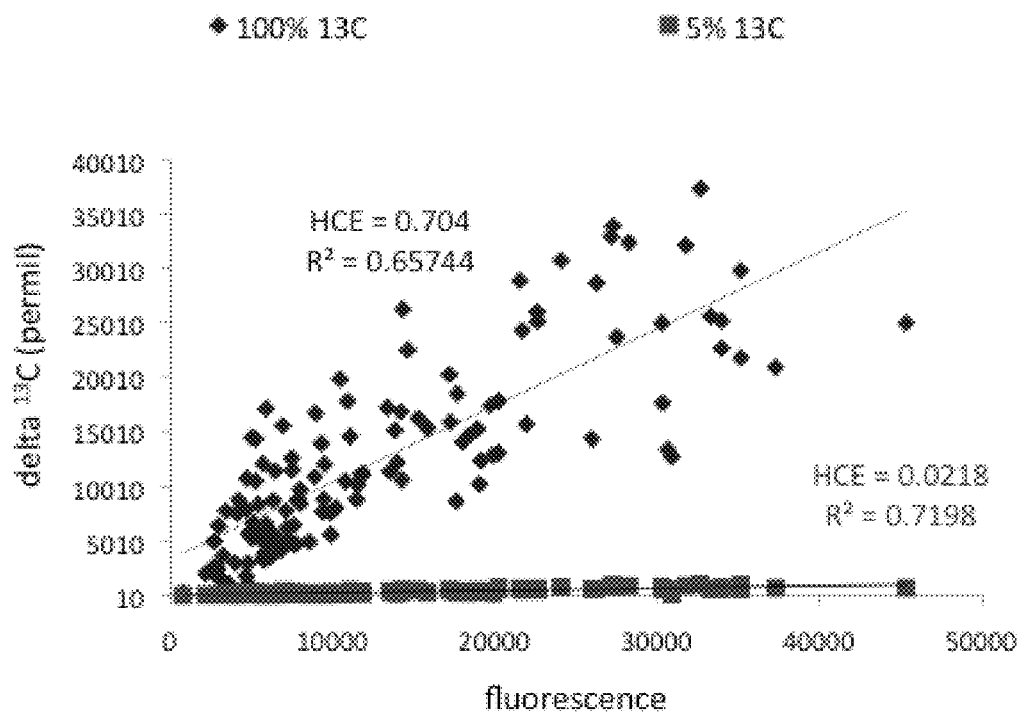
FIG. 9 shows the relationship between array fluorescence (a metric of RNA hybridization) and $^{13}$C/$^{12}$C enrichment (analyzed by NanoSIMS) of RNA from *Pseudomonas stutzeri* cultures grown separately on two levels of $^{13}$C-glucose as a sole carbon source and hybridized to an indium tin oxide (ITO) microarray. Each point represents data from a single probe location on the array. The fluorescence:enrichment relationship (i.e. hybridization corrected enrichment, "HCE") is both highly significant (see regression statistics) and different between RNA from cultures with 100% $^{13}$C (gray) versus 5% $^{13}$C enriched cultures (dark gray).

To test the chip-SIP approach, we grew a single bacterial strain (*Pseudomonas stutzeri*) in a minimal medium with $^{13}C$-glucose as the sole carbon source and extracted its RNA. After fluorescent labeling, the RNA was hybridized to a microarray probe set consisting of >100 sequences targeting different regions of the *P. stutzeri* 16S rRNA gene. Measured isotopic enrichment of these probe spots strongly depended on the efficiency of target RNA hybridization, as quantified by fluorescence (FIGS. 1A, 1B). This correlation is the result of dilution of the target RNA isotopic signal by the background of unenriched oligonucleotide probes. Thus, if less target RNA hybridizes to the array surface, higher dilution results in a lower measured isotopic enrichment. Relative isotopic enrichment of RNA from an organism can be quantified based on the slope of the enrichment:fluorescence relationship for a single probe set. We refer to this value as the hybridization-corrected enrichment (HCE; FIG. 9).

Figure 2A:
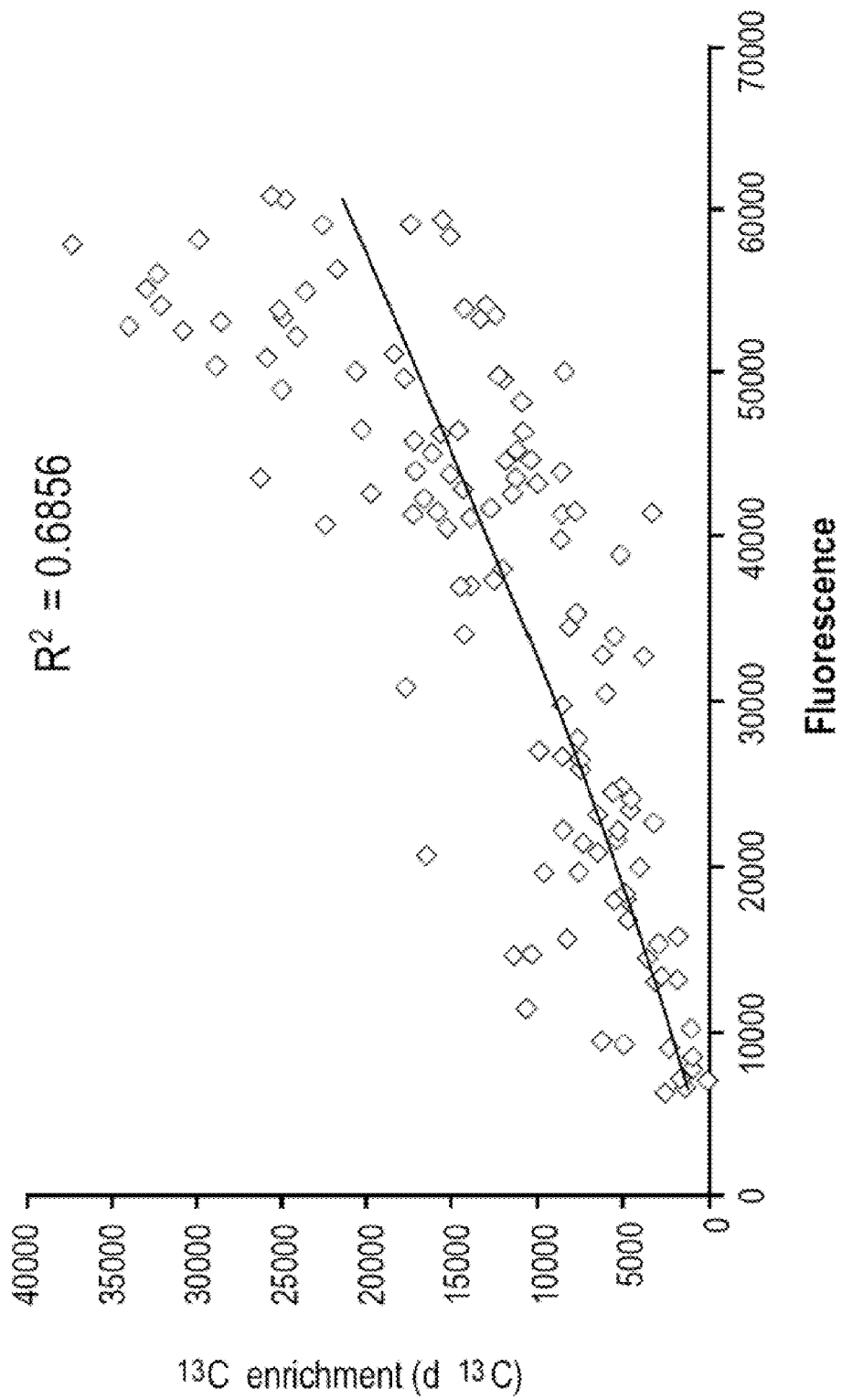
FIG. 2A is a graph that shows that fluorescence and $^{13}$C enrichment are positively correlated demonstrating successful detection of labeled RNA in FIG. 1.
Figure 2B:
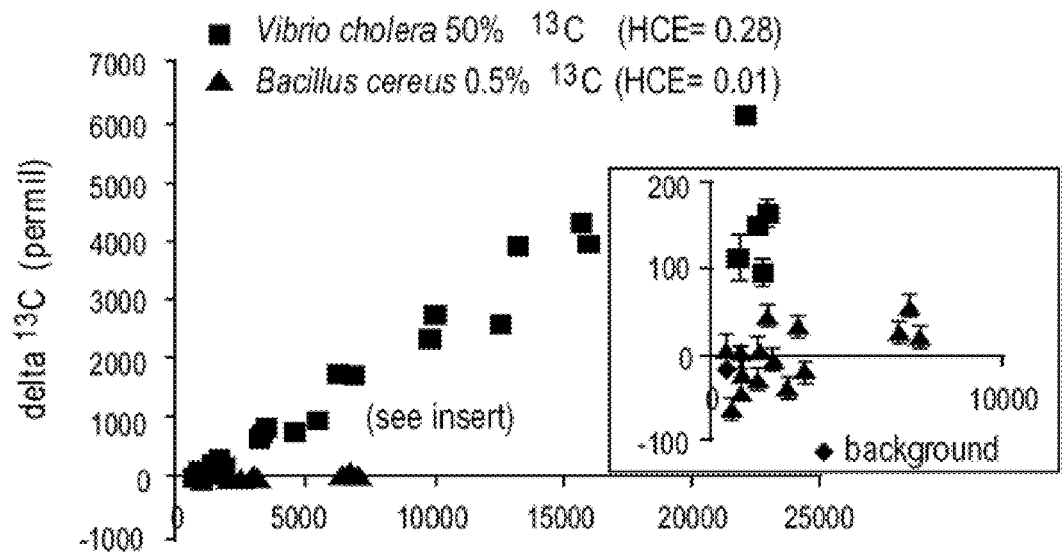
FIGS. 2B and 2C show Chip-SIP analysis of two strains with differential isotopic enrichment demonstrating clear separation of the two taxa; *Vibrio cholerae* (gray squares), *Bacillus cereus* (gray triangles), background (black diamond). HCE=hybridization-corrected enrichment. Each point represents an individual probe spot's fluorescence intensity value (a measure of fluorescence) plotted against its isotopic enrichment measured by NanoSIMS. Error bars are SEMs based on total ion counts.
Figure 2C:
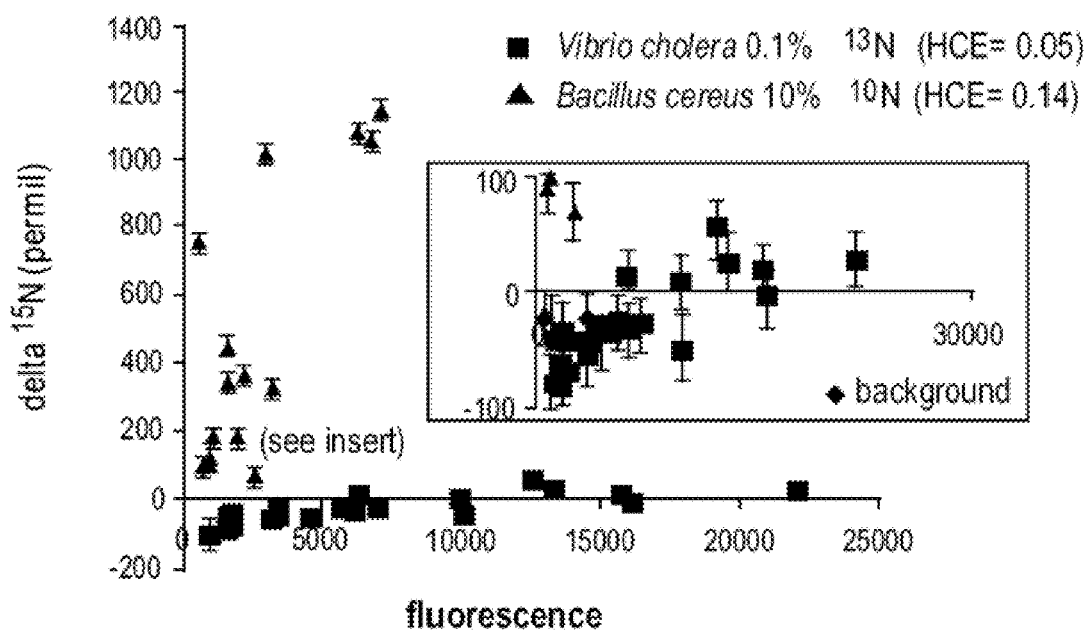

Before applying chip-SIP to natural communities, we sought to test its sensitivity and ability to discriminate a mixture of differentially labeled bacterial taxa. Two bacterial strains, *Vibrio cholerae* and *Bacillus cereus*, were grown separately to different $^{15}N$ and $^{13}C$ isotopic enrichments, then their combined RNA was hybridized to an array consisting of probe sets targeting each organism. Both $^{13}C$ (FIG. 2B) and $^{15}N$ (FIG. 2C) enrichment can easily be distinguished for each taxon based on their respective HCEs, which were significantly different (ANCOVA; p<0.0001). By integrating the results from each organism's probe set (10-20 probes/taxon), the HCE values allow the direct comparison of isotopic incorporation between two or more taxa on a single array. Notably, we successfully detected isotopic enrichments as low as 0.5% $^{13}C$ RNA (half of background $^{13}C$) and 0.1% $^{15}N$ RNA (one third of background $^{15}N$), enrichment levels that traditional SIP techniques currently cannot resolve (8, 10).

EXAMPLE 2

Materials and Methods

These present example describes the materials and methods used in the Examples.

Growth of Single Strains and Incubation of Field Samples.

Strains of *Pseudomonas stutzeri* ATTC 11607, *Vibro cholerae* ATCC 14104, and *Bacillus cereus* D17 were grown from −80° C. frozen stock in Luria-Bertani (LB) broth at 37° C. until late log phase, and transferred into $^{12}C$ glucose-amended M9 minimal medium until late log phase. Then, a 10 µl aliquot was inoculated into 10 ml of M9 enriched in $^{13}C$ glucose and/or $^{15}N$ ammonium and the culture was again grown until late log phase. An enrichment of 10% $^{13}C$ indicates 10% of the glucose in the medium was 99% enriched in $^{13}C$, and 90% of the glucose had natural carbon (1.1% $^{13}C$ and 98.9% $^{12}C$). Cells were centrifuged, washed, and frozen at −80° C. Bulk measurements (by Isotope Ratio Mass Spectrometry) showed that *Pseudomonas* cells grown in full $^{13}C$ glucose were enriched between 680,000 and 900,000 permil, equivalent to 90 atm %.

For field experiments, surface water was collected at the public pier in Berkeley, Calif. USA (37°51'46.67"N, 122°19'3.23"W) and immediately brought back to the laboratory i cooler. Glass bottles (500 ml) were filled without air space and dark incubated at 14° C. For the first set of experiments, samples were simultaneously incubated with 50 µM 99 atm % $^{13}C$ glucose and 200 µM 99 atm % $^{15}N$ ammonium, and subsamples harvested after 2, 6, and 24 hrs by filtration through a 0.22 polycarbonate filter which was then immediately frozen at −80° C. Background concentrations of ammonium in San Francisco bay range from 1-14 µM (1); typically estuarine glucose concentrations are 5-100 nM (2). For the second set of experiments, water samples were incubated as described above with 8 µM mixed amino acids (99 atm % $^{13}C$ and 99 atm % $^{15}N$ labeled; Omicron), 500 µg L$^{-1}$ algal fatty acids (98 atm % $^{13}C$; Omicron), or 50 µg L$^{-1}$ nucleic acids (90 atm % $^{13}C$; RNeasy extract from $^{13}C$ *Pseudomonas stutzeri*), collected by filtration after 12 hrs and frozen at −80° C. These substrate additions were designed to result in concentrations at the high end of what is typically measured in estuarine environments: 2-7 µM amino acids (3), 25 µg L$^{-1}$ fatty acids (4) and 10 µg L$^{-1}$ DNA (5).

RNA Extraction and Labeling.

RNA from pelleted cells (laboratory strains) and filters (field samples) was extracted with the Qiagen RNEasy kit according to manufacturer's instructions, with slight modifications for the field samples. Filters were incubated in 200 µL TE buffer with 5 mg mL$^{-1}$ lysozyme and vortexed for 10 min at RT. RLT buffer (800 µL, Qiagen) was added, vortexed, centrifuged, and the supernatant was transferred to a new tube. Ethanol (560 µl) was added, mixed gently, and the sample was applied to the provided minicolumn. The remaining manufacturer's protocol was subsequently followed. At this point, RNA samples were split: one fraction saved for fluorescent labeling (see below), the other was kept unlabeled for NanoSIMS analysis. This procedure was used because the fluorescent labeling protocol introduces background carbon (mostly $^{12}C$) that dilutes the $^{13}C$ signal (data not shown). Alexafluor 546 labeling was done with the Ulysis kit (Invitrogen) for 10 min at 90° C. (2 µL RNA, 10 µL labeling buffer, 2 µL Alexafluor reagent), followed by fragmentation. All RNA (fluorescently labeled or not) was fragmented using 5× fragmentation buffer (Affymetrix) for 10 min at 90° C. before hybridization. Labeled RNA was purified using a SpinOUT™ minicolumn (Millipore), and RNA was concentrated by ethanol precipitation to a final concentration of 500 ng µL$^{-1}$.

Target Taxa Selection by PhyloC Hip Analysis and De Novo Probe Design.

RNA extracts from SF Bay SIP experiment samples were treated with DNAse I and reverse-transcribed to produce cDNA using the Genechip Expression 3' amplification one-cycle cDNA synthesis kit (Affymetrix). The cDNA was PCR amplified with bacterial and archaeal primers, fragmented, fluorescently labeled, and hybridized to the G2 PhyloChip which is described by E. L. Brodie et al., in "Application of a high-density oligonucleotide microarray approach to study bacterial population dynamics during uranium reduction and reoxidation." *Appl. Environ. Microbiol.* 72, 6288 (2006) hereby incorporated by reference, and commercially available from Affymetrix (Santa Clara, Calif.) through Second Genome (San Francisco, Calif.).

Taxa (16S operating taxonomic units, OTU) considered to be present in the samples were identified based on 90% of the probes for that taxon being responsive, defined as the signal of the perfect match probe>1.3 times the signal from the mismatch probe. From approximately 1500 positively identified taxa, we chose a subset of 100 taxa commonly found in marine environments to target with chip-SIP. We also did not target OTUs previously identified from soil, sewage, and bioreactors as our goal was to characterize the activity of marine microorganisms. Using the Greengenes database (7)

implemented in ARB (8), we designed 25 probes (25 bp long), to create a 'probe set' for each taxon (Table 1; SEQ ID NOS: 1-2805), as well as general probes for the three domains of life. Probes for single laboratory strains (*Pseudomonas stutzeri, Bacillus cereus*, and *Vibrio cholerae*) were also designed with ARB (Table 1).

Microarray Synthesis and Hybridization.

A custom conductive surface for the microarrays was used to eliminate charging during SIMS analysis. Glass slides coated with indium-tin oxide (ITO; Sigma) were treated with an alkyl phosphonate hydroxy-linker (patent pending) to provide a starting substrate for DNA synthesis. Custom-designed microarrays (spot size=17 μm) were synthesized using a photolabile deprotection strategy (9) on the LLNL Maskless Array Synthesizer (Roche Nimblegen, Madison, Wis.). Reagents for synthesis (Roche Nimblegen) were delivered through the Expedite (PerSeptive Biosystems) system. For quality control (to determine that DNA synthesis was successful), slides were hybridized with complimentary *Arabidopsis* calmodulin protein kinase 6 (CPK6) labeled with Cy3 (Integrated DNA Technologies), which hybridized to fiducial marks, probe spots with the complementary sequence synthesized throughout the array area. Probes targeting microbial taxa were arranged in a densely packed formation to decrease the total area analyzed by imaging secondary ion mass spectrometry (NanoSIMS). For array hybridization, RNA samples in 1× Hybridization buffer (NimbleGen) were placed in Nimblegen X4 mixer slides and incubated inside a Maui hybridization system (BioMicro® Systems) for 18 hrs at 42° C. and subsequently washed according to manufacturer's instructions (NimbleGen). Arrays with fluorescently labeled RNA were imaged with a Genepix 4000B fluorescence scanner at pmt=650 units. Arrays with non-fluorescently labeled RNA were marked with a diamond pen and also imaged with the fluorescence scanner to subsequently navigate to the analysis spots in the NanoSIMS. These spots were observable in the fluorescence image because fiducial probe spots were synthesized around the outline of the area to be analyzed by NanoSIMS. Prior to NanoSIMS analysis, samples were not metal coated to avoid further dilution of the RNA's isotope ratio or loss of material. Slides were trimmed and mounted in custom-built stainless steel holders.

NanoSIMS Analyses.

Secondary ion mass spectrometry analysis of microarrays hybridized with $^{13}$C and/or $^{15}$N rRNA was performed at LLNL with a Cameca NanoSIMS 50 (Cameca, Gennevilliers, France). A Cs+ primary ion beam was used to enhance the generation of negative secondary ions. Carbon and nitrogen isotopic ratios were determined by electrostatic peak switching on electron multipliers in pulse counting mode, alternately measuring $^{12}C^{14}N^-$ and $^{12}C^{15}N^-$ simultaneously for the $^{15}N/^{14}N$ ratio, and then simultaneously measuring $^{12}C^{14}N^-$ and $^{13}C^{14}N^-$ for the $^{13}C/^{12}C$ ratio. We used this peak switching strategy because the secondary ion count rate for the CN$^-$ species in these samples is 5-10 times higher than any of the other carbon species (e.g., C$^-$, CH$^-$, C$_2^-$), and therefore higher precision was achieved even though total analytical time was split between the two CN$^-$ species at mass 27. If only one isotopic ratio was needed, peak switching was not performed. Mass resolution was set to ~10,000 mass resolving power to minimize the contribution of isobaric interferences to the species of interest (e.g., $^{11}B^{16}O^-$ contribution to $^{13}C^{14}N^-$<1/100; $^{13}C_2^-$ contribution to $^{12}C^{14}N^-$<1/1000). Analyses were performed in imaging mode to generate digital ion images of the sample for each ion species. Analytical conditions were optimized for speed of analysis, ability to spatially resolve adjacent hybridization locations, and analytical stability. The primary beam current was 5 to 7 pA Cs+, which yielded a spatial resolution of 200-400 nm and a maximum count rate on the detectors of ~300,000 cps $^{12}C^{14}N$. Analysis area was 50×50 μm$^2$ with a pixel density of 256×256 with 0.5 or 1 ms/pixel dwell time. For peak switching, one scan of the analysis area was made per species set, resulting in two scans per analytical cycle. With these conditions, reproducible secondary ion ratios could be measured for a maximum of 4 cycles through the two sets of measurements before the sample was largely consumed. Data were collected for 2 to 4 cycles. Based on total counts for the analyzed cycles, we achieved precision of 2-3% for $^{13}C^{14}N$ and 1-4% for $^{15}N^{12}C$, depending on the enrichment and hybridization intensity. A single microarray analysis of approximately 2500 probes, with an area of 0.75 mm$^2$ and the acquisition of 300 images, was carried out using the Cameca software automated chain analysis in 16 hours. Ion images were stitched together and processed to generate isotopic ratios with custom software (LIMAGE, L. Nittler, Carnegie Institution of Washington). Ion counts were corrected for detector dead time on a pixel by pixel basis. Hybridization locations were selected by hand or with the auto-ROI function, and ratios were calculated for the selected regions over all cycles to produce the location isotopic ratios. Isotopic ratios were converted to delta values using δ=[(R$_{meas}$/R$_{standard}$)−1]×1000, where R$_{meas}$ is the measured ratio and R$_{standard}$ is the standard ratio (0.00367 for $^{15}N/^{14}N$ and 0.011237 for $^{13}C/^{12}C$). Data were corrected for natural abundance ratios measured in unhybridized locations of the sample.

Data Analyses.

For each taxon, isotopic enrichment of individual probe spots was plotted against fluorescence and the linear regression slope was calculated with the y-intercept constrained to natural isotope abundances (zero permil for $^{15}$N data and −20 permil for $^{13}$C data). This calculated slope (permil/fluorescence), which we refer to as the 'hybridization-corrected enrichment (HCE), is a metric that can be used to compare the relative incorporation of a given substrate by different taxa. It should be noted that due to the different natural concentrations of $^{13}$C and $^{15}$N, and more importantly, different background contributions from the microarray, HCEs for $^{15}$N substrates and $^{13}$C substrates are not comparable. To construct a network diagram (e.g. FIG. 8A), taxa with HCEs having standard errors not overlapping with zero and with >30 permil enrichment were included (all others were discarded) using Cytoscape software (10). For analyses of marine bacterial genomic information, genomes of marine bacterial isolates were selected in the Joint Genome Institute's Integrated Microbial Genomes (IM-G) database and word-searched for the presence of amino acid, fatty acid, and nucleoside transporters and extracellular nucleases. Results are summarized in Table S2. For phylogenetic relationships (FIG. 8B), the global 16S rRNA phylogeny in the Greengenes database (7) was opened in ARB (8) and all taxa except the targets of the array analysis were removed with the taxon pruning function.

EXAMPLE 3

Viability of Chip-SIP on a San Francisco Bay Sample

Figure 10:
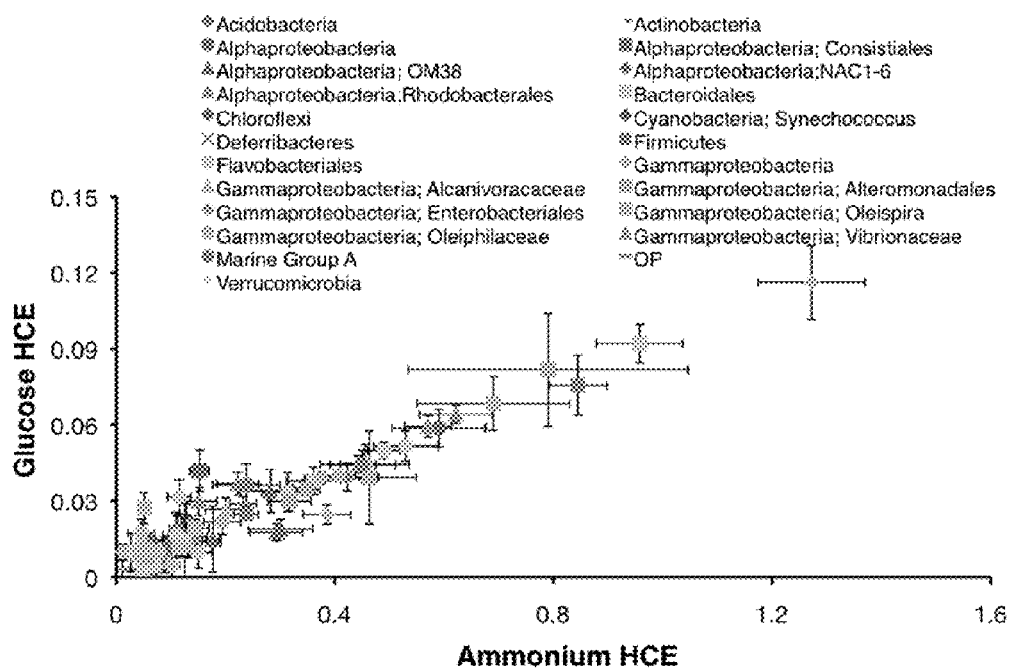
FIG. 10: Relative incorporation of $^{15}$N-ammonium and $^{13}$C-glucose detected by chipSIP for a natural estuarine microbial community from the San Francisco Bay. Units are the slope of permil isotope enrichment over fluorescence (HCE=hybridization corrected enrichment). Each point is the average of probe spots representing the identified phyla. Error bars represent the standard error of the slope calculation.
Figure 11:
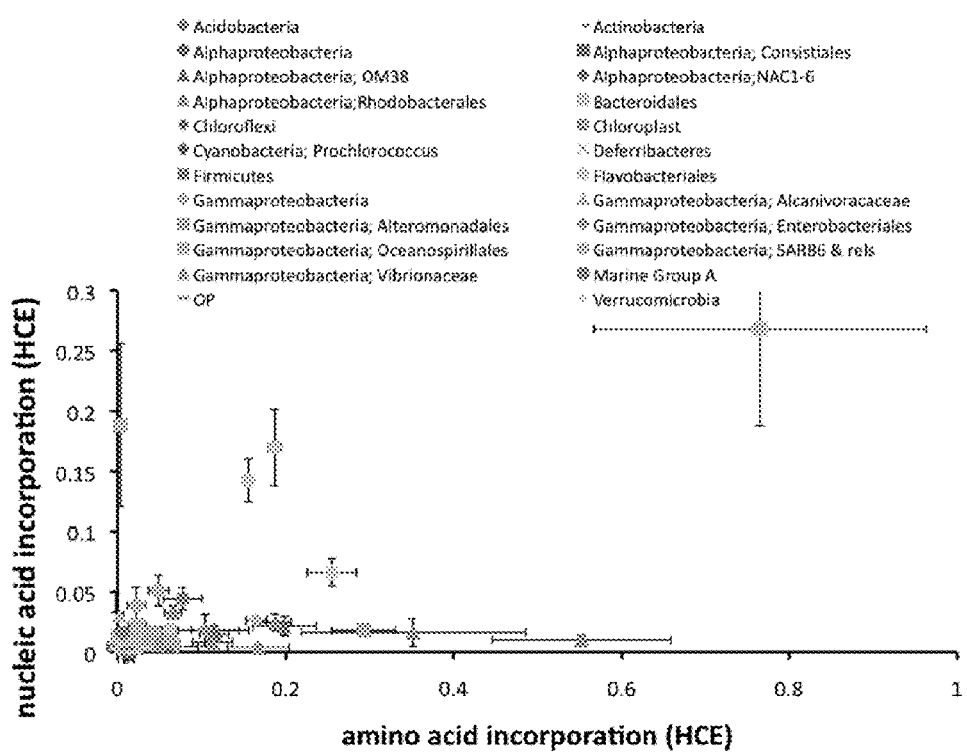
FIG. 11: Relative incorporation of amino acids and nucleic acids detected by chip-SIP for a natural estuarine microbial community from the San Francisco Bay. Units are the slope of permil enrichment over fluorescence (HCE=hybridization corrected enrichment).
Figure 12:
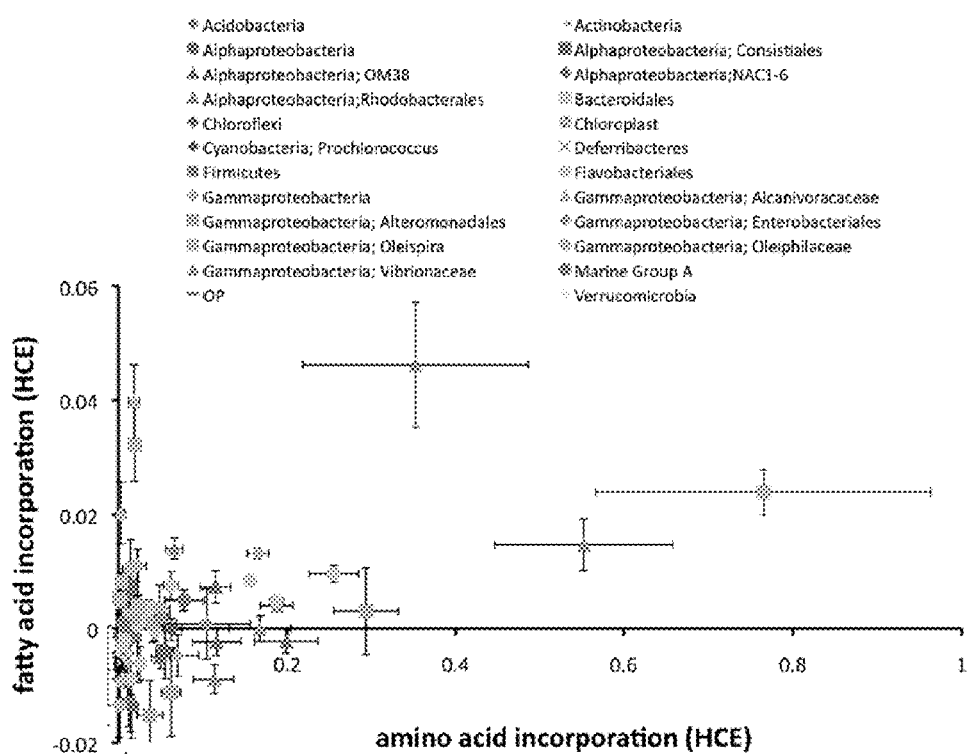
FIG. 12: Relative incorporation of amino acids and fatty acids detected by chip-SIP for a natural estuarine microbial community. Units are the slope of permil enrichment over fluorescence (HCE=hybridization corrected enrichment).
Figure 13:
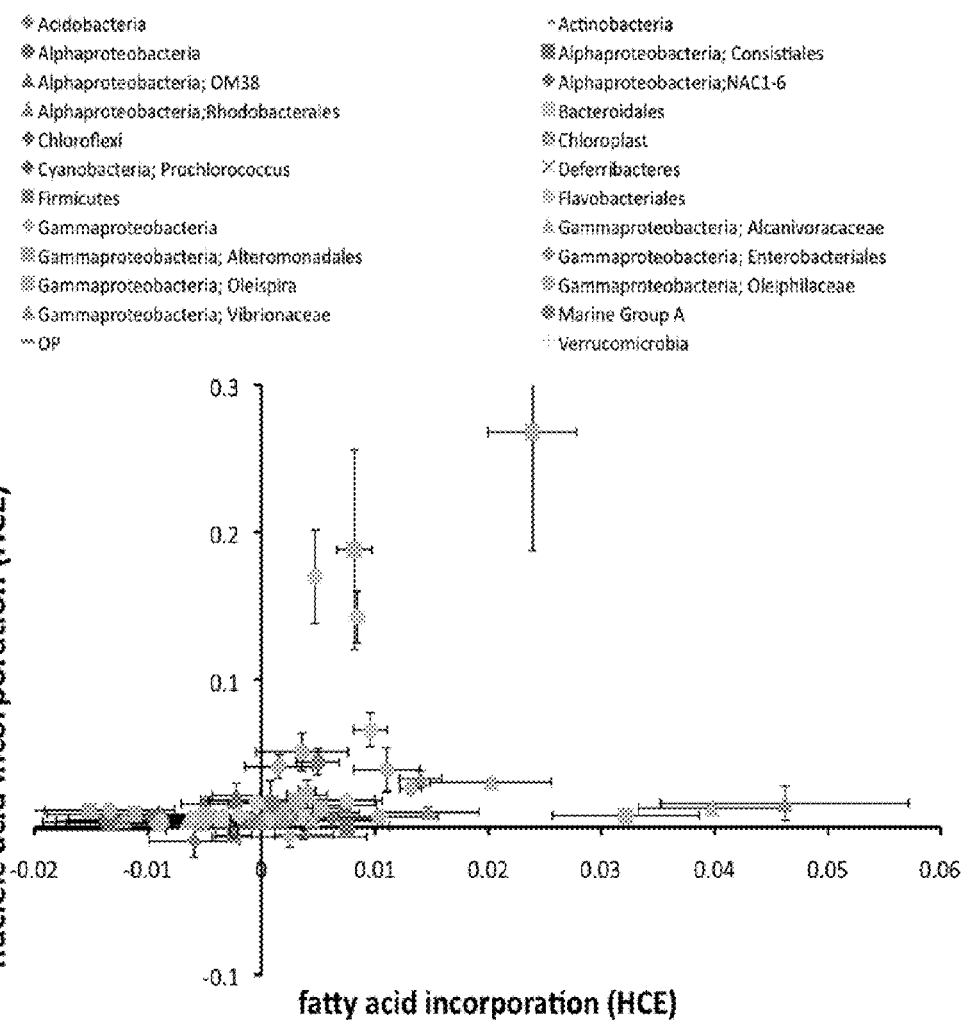
FIG. 13: Relative incorporation of fatty acids and nucleic acids detected by chip-SIP for a natural estuarine microbial community. Units are the slope of permil enrichment over fluorescence (HCE=hybridization corrected enrichment).

In a second set of experiments, we tested the viability of chip-SIP for a diverse natural community, using a sample from the San Francisco (SF) Bay, a eutrophic estuary. The bay water was incubated in the dark with micromolar concentrations of $^{15}$N ammonium and $^{13}$C glucose for 24 hrs, a timescale long enough to ensure detectable isotopic labeling of the dominant active community. We expected the most active taxa to incorporate these substrates, as they are of small molecular weight, do not require extracellular breakdown before uptake, and directly feed into central carbon and nitrogen metabolic pathways. This chip-SIP array consisted of 2500 probes targeting 100 microbial taxa selected from a PhyloChip analysis of the same sample (Table 1; 16). Based on RNA fluorescence, we positively detected 73 taxa. As in the experiments with laboratory cultures, the relationship between fluorescence and isotopic incorporation for each taxon was positive and linear for both $^{15}$N and $^{13}$C (e.g. FIGS. 7A, 7B for three Rhodobacteraceae probes sets), demonstrating that different members of the same bacterial families could incorporate different levels of $^{15}$N from ammonium and $^{13}$C from glucose. Though these substrate concentrations may have favored copiotrophs (17), we detected the model oligotroph *Pelagibacter* (FIGS. 10, 18). This result demonstrates that even oligotrophic organisms retained a presence and detectable biogeochemical activity in this highly eutrophic environment.

Figure 7:
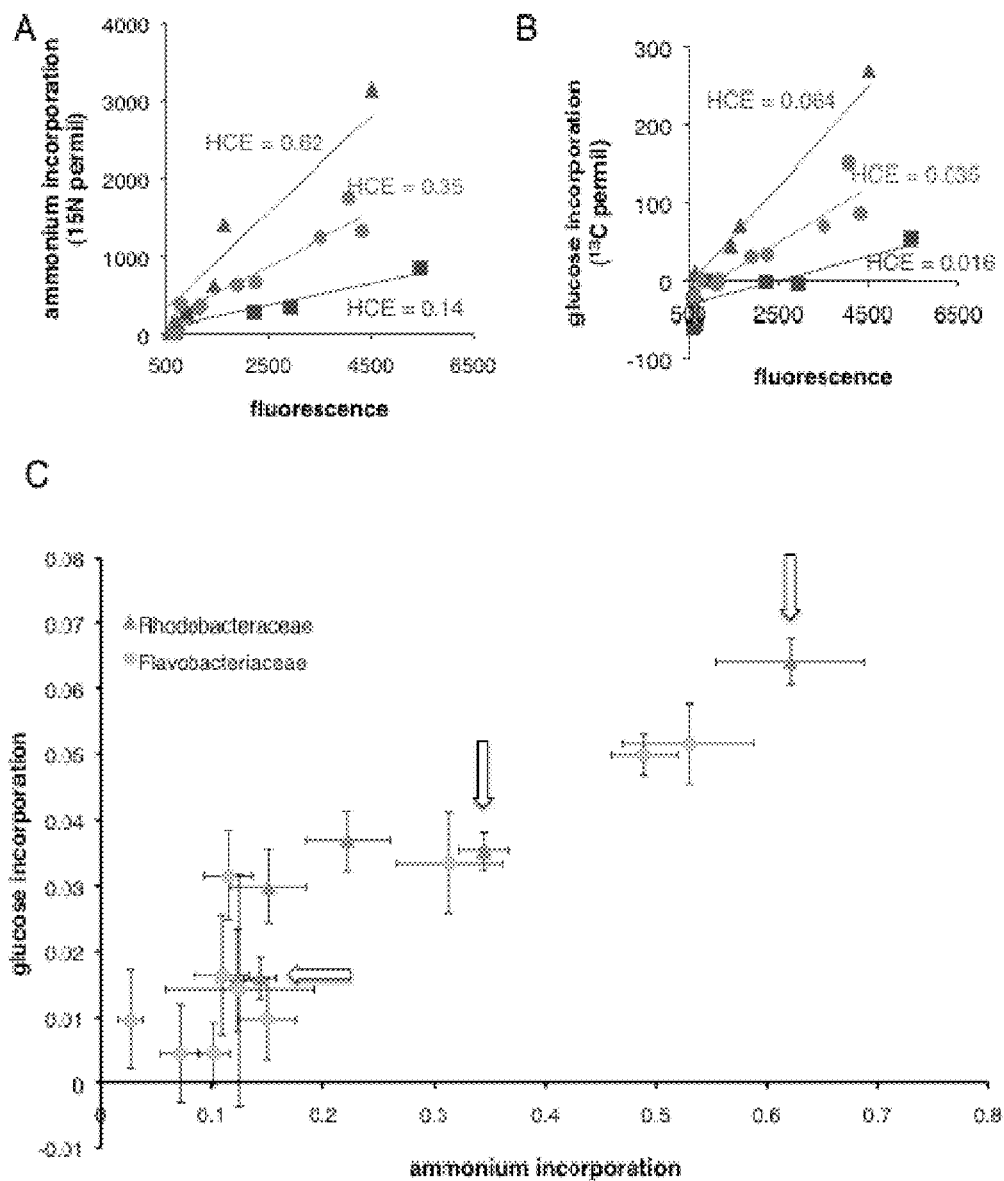
FIG. 7 shows substrate incorporation detected by chip-SIP for a SF Bay estuarine microbial community incubated with 200 μM$^{15}$N ammonium and 50 μM$^{13}$C glucose for 24 hrs; A) $^{15}$N ammonium and B) $^{13}$C glucose incorporation for 3 taxa within the bacterial family Rhodobacteriaceae; each point is derived from a single probe spot's isotopic enrichment value plotted against fluorescence (a measurement of hybridization); C) relationship between ammonium and glucose incorporation for 16 taxa from two bacterial families; HCE=hybridization-corrected enrichment; arrows indicate taxa plotted in A and B.

An advantage of chip-SIP's ability to detect $^{13}$C and $^{15}$N on the same array is its potential to uncover physiological diversity, based on the relative incorporation of two substrates incubated simultaneously. Our ability to measure taxon-specific substrate incorporation allowed us to reveal that the relationship between ammonium and glucose incorporation was linear: organisms with high ammonium incorporation (high $^{15}$N HCEs) also exhibited high glucose incorporation (high $^{13}$C HCEs), and vice versa (FIGS. 7C, 10). A previous experiment illustrated an analogous pattern using lower resolution bulk measurements comparing marine water samples amended with different levels of glucose and ammonium(19). The authors found that community wide C/N assimilation was constant, irrespective of the absolute amount of substrates added. Our data revealed that this pattern also occurs within the same water sample, in which different microbial populations represent physiologically distinct components of the community. We also showed that relatively broad phylogenetic clades (family level, in this case) did not correspond to substrate incorporation patterns: members of the same bacterial family were scattered throughout the HCE distribution. For example, members of the Flavobacteriaceae did not incorporate less (or more) substrate than the Rhodobacteraceae, because within each family, there were taxa with both high and low incorporation (FIG. 7C).

EXAMPLE 4

Viability of Chip-SIP on a San Francisco Bay Sample

Marine microorganisms, most of which remain uncultivated, control the release, transformation, and remineralization of ~50 Gigatons of fixed carbon annually, resulting in biological carbon sequestration to the deep sea (P. Falkowski et al., The global carbon cycle: a test of our knowledge of earth as a system. *Science* 290, 291 (2000)). Identifying the microbes responsible for C cycling processes in the marine microbial loop and the factors affecting C cycling rates in marine ecosystems is a critical precursor to the development of predictive models of microbial responses to environmental perturbations (e.g., pollution, nutrient inputs or global change). Currently, the ecological niches of marine microorganisms, heterotrophic bacteria in particular, are often categorized as "copiotrophic" or "oligotrophic" depending on their predominant location, for example high-nutrient and particle-rich coasts versus low-nutrient open oceans, or warm, well-lit, productive surface waters versus the cold, dark deep (S. J. Giovannoni, U. Stingl, Molecular diversity and ecology of microbial plankton. *Nature* 437, 343 (2005)). The advent of 16S rRNA sequencing and environmental genomics have revolutionized marine microbial ecology by assembling a "parts list" of genetic diversity (M. S. Rappé, P. F. Kemp, S. J. Giovannoni, Phylogenetic diversity of marine coastal picoplankton 16S rRNA genes cloned from the continental shalf off Cape Hatteras, N.C. *Limnol. Oceanogr.* 42, 811 (1997)) and functional capability (E. F. DeLong et al., Community genomics among stratified microbial assemblages in the ocean's Interior. *Science* 311, 496 (2006)), but the goal of linking phylogenetic identity and in situ functional roles of uncultivated microorganisms remains largely unattained. In addition, while the comparative 'omics strategy to gain ecosystem functional information has been fruitful, it relies on sequence comparison rather than direct measurements of biogeochemical activity. To gain a mechanistic understanding of microbial control of biogeochemical cycles in the ocean and elsewhere, it is necessary to move beyond microbial diversity or metagenomic surveys towards trait-based functional studies that directly and simultaneously measure the biogeochemical activities of hundreds of microbial taxa in their native environment.

In a third set of experiments, we compared predicted and actual substrate use of three organic substrates by a diverse natural community, an example of the type of experiment that can eventually lead to more realistic models of marine food web structure (20). In this case, we applied chip-SIP to another set of SF Bay samples incubated separately with isotopically-labeled amino acids, nucleic acids, and fatty acids. These substrates make up a significant proportion of photoautotrophic biomass (21) that provide the majority of fixed carbon substrates for the marine microbial food web.

Figure 8A:
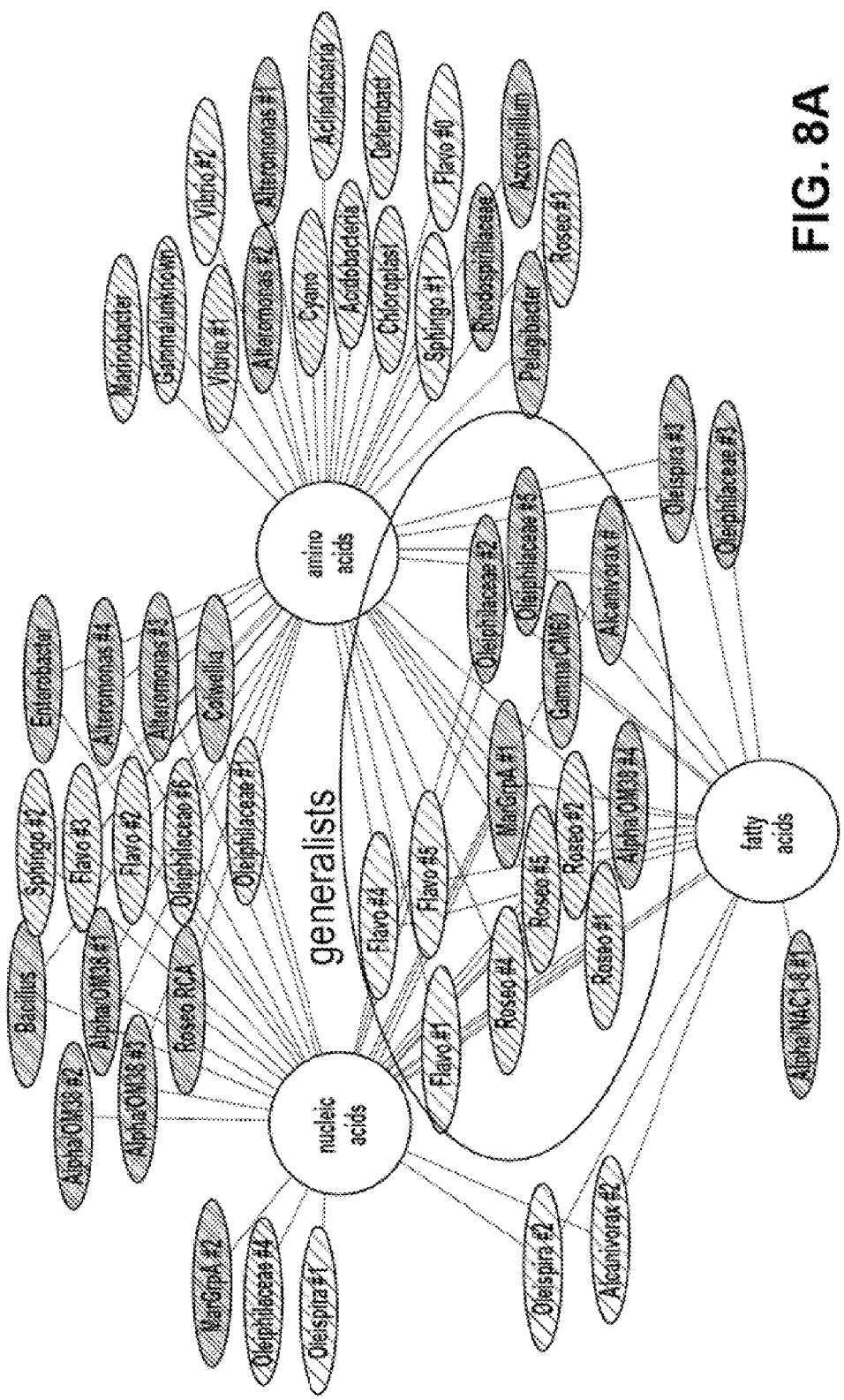
FIG. 8A shows a network map of Chip-SIP analysis of the uptake patterns of three organic substrates by different bacterial taxa in an estuary, identifying substrate specialists and generalists; the thicknesses of the lines are proportional to the substrate incorporation rates based on HCE calculations (Flavo=Flavobacteriaceae, Roseo=Roseobacter, MarGrpA=Marine Group A).

We detected isotopic enrichment of at least one of the three added substrates in 52 out of the 81 taxa with positive RNA hybridization (FIGS. 10-13). A network diagram, based on the measured HCE values, illustrates the movement of organic matter between substrates and microbial taxa, and clearly indicates generalists that incorporated all three substrates versus specialist consumers of only one substrate (FIG. 8A). Our analysis reveals that generalists and specialists were not necessarily distinguishable based on 16S phylogeny. In other words, members of a bacterial family could be generalists while others specialists. Such an analysis, which includes quantitative information (visualized by the thickness of the lines connecting substrates to taxa), is a substantial step forward in our understanding of organic matter flow in the microbial loop.

To compare genome-predicted potential biogeochemical activity to our measured substrate incorporation data, we examined the presence of genes involved in the extracellular degradation or transport of these substrates in the sequenced genomes of marine bacterial isolates (Table 2). Table 2 is shown below:

TABLE S2 presence of identified amino acid transporters, extracellular nucleases, and nucleoside and fatty acid transport in 110 genomes of marine bacterial isolates. Word searches performed with Joint Genome Institute's Integrated Microbial Genomes (IMG) online at IMG JGI website.

| Genome | Amino acid transport | Extracellular nuclease | Nucleoside transport | Fatty acid transport |
|---|---|---|---|---|
| *Agreia* sp. PHSC20C1 | Y | N | N | N |
| *Algoriphagus* sp. PR1 | Y | N | Y | Y |
| *Aurantimonas* sp. SI85-9A1 | Y | N | N | N |

TABLE S2-continued presence of identified amino acid transporters, extracellular nucleases, and nucleoside and fatty acid transport in 110 genomes of marine bacterial isolates. Word searches performed with Joint Genome Institute's Integrated Microbial Genomes (IMG) online at IMG JGI website.

| Genome | Amino acid transport | Extracellular nuclease | Nucleoside transport | Fatty acid transport |
|---|---|---|---|---|
| *Bacillus* sp. B14905 | Y | N | Y | N |
| *Bacillus* sp. NRRL B-14911 | Y | N | Y | N |
| *Bacillus* sp. SG-1 | Y | Y | Y | N |
| *Beggiatoa* sp. PS | Y | N | N | Y |
| *Bermanella marisrubri* | Y | N | N | Y |
| *Blastopirellula marina* DSM 3645 | Y | Y | N | N |
| *Caminibacter mediatlanticus* TB-2 | Y | N | N | N |
| *Candidatus Blochmannia pennsylvanicus* BPEN | Y | N | N | N |
| *Candidatus Pelagibacter ubique* HTCC1002 | Y | N | N | N |
| *Carnobacterium* sp. AT7 | Y | N | Y | Y |
| *Congregibacter litoralis* KT71 | Y | N | Y | N |
| *Croceibacter atlanticus* HTCC2559 | Y | Y | Y | N |
| *Cyanothece* sp. CCY 0110 | Y | N | Y | N |
| *Dokdonia donghaensis* MED134 | Y | Y | Y | N |
| *Erythrobacter litoralis* HTCC2594 | Y | N | Y | Y |
| *Erythrobacter* sp. NAP1 | Y | N | N | N |
| *Erythrobacter* sp. SD-21 | Y | N | Y | N |
| *Finegoldia magna* ATCC 29328 | Y | N | N | N |
| *Flavobacteria bacterium* BAL38 | Y | N | N | Y |
| *Flavobacteria bacterium* BBFL7 | N | Y | N | N |
| *Flavobacteriales bacterium* ALC-1 | Y | N | Y | N |
| *Flavobacteriales bacterium* HTCC2170 | Y | N | Y | N |
| *Fulvimarina pelagi* HTCC2506 | Y | N | N | Y |
| *Hoeflea phototrophica* DFL-43 | Y | N | N | Y |
| *Hydrogenivirga* sp. 128-5-R1-1 | Y | N | N | N |
| *Idiomarina baltica* OS145 | Y | Y | N | Y |
| *Janibacter* sp. HTCC2649 | Y | Y | N | N |
| *Kordia algicida* OT-1 | Y | Y | N | Y |
| *Labrenzia aggregata* IAM 12614 | Y | N | N | N |
| *Leeuwenhoekiella blandensis* MED217 | Y | N | Y | N |
| *Lentisphaera araneosa* HTCC2155 | Y | N | N | Y |
| *Limnobacter* sp. MED105 | Y | N | N | Y |
| *Loktanella vestfoldensis* SKA53 | Y | N | N | N |
| *Lyngbya* sp. PCC 8106 | Y | Y | Y | N |
| marine gamma proteobacterium HTCC2080 | Y | Y | Y | Y |
| marine gamma proteobacterium HTCC2143 | Y | N | N | N |
| marine gamma proteobacterium HTCC2148 | Y | N | N | N |
| marine gamma proteobacterium HTCC2207 | Y | N | N | N |
| *Marinobacter algicola* DG893 | Y | Y | N | Y |
| *Marinobacter* sp. ELB17 | Y | N | N | Y |
| *Marinomonas* sp. MED121 | Y | Y | N | N |
| *Mariprofundus ferrooxydans* PV-1 | Y | N | N | Y |
| *Methylophilales bacterium* HTCC2181 | N | N | N | N |
| *Microscilla marina* ATCC 23134 | Y | Y | Y | N |
| *Moritella* sp. PE36 | Y | Y | Y | Y |
| *Neptuniibacter caesariensis* | Y | N | N | N |
| *Nisaea* sp. BAL199 | Y | N | N | Y |
| *Nitrobacter* sp. Nb-311A | Y | N | N | N |
| *Nitrococcus mobilis* Nb-231 | Y | N | N | N |
| *Nodularia spumigena* CCY9414 | Y | N | N | N |
| *Oceanibulbus indolifex* HEL-45 | Y | N | Y | Y |
| *Oceanicaulis alexandrii* HTCC2633 | Y | N | N | N |
| *Oceanicola batsensis* HTCC2597 | Y | Y | N | N |
| *Oceanicola granulosus* HTCC2516 | Y | Y | Y | N |
| *Parvularcula bermudensis* HTCC2503 | Y | Y | Y | N |
| *Pedobacter* sp. BAL39 | Y | N | N | Y |
| *Pelotomaculum thermopropionicum* SI | Y | N | N | N |
| *Phaeobacter gallaeciensis* 2.10 | Y | N | N | N |
| *Phaeobacter gallaeciensis* BS107 | Y | N | N | N |
| *Photobacterium angustum* S14 | Y | Y | Y | Y |
| *Photobacterium profundum* 3TCK | Y | Y | Y | Y |
| *Photobacterium* sp. SKA34 | Y | Y | Y | Y |
| *Planctomyces maris* DSM 8797 | Y | Y | N | N |
| *Plesiocystis pacifica* SIR-1 | Y | N | Y | Y |
| *Polaribacter irgensii* 23-P | Y | Y | Y | N |
| *Polaribacter* sp. MED152 | Y | Y | Y | N |
| *Prochlorococcus marinus* AS9601 | N | N | N | N |

TABLE S2-continued presence of identified amino acid transporters, extracellular nucleases, and nucleoside and fatty acid transport in 110 genomes of marine bacterial isolates. Word searches performed with Joint Genome Institute's Integrated Microbial Genomes (IMG) online at IMG JGI website.

| Genome | Amino acid transport | Extracellular nuclease | Nucleoside transport | Fatty acid transport |
|---|---|---|---|---|
| *Prochlorococcus marinus* MIT 9211 | Y | N | N | N |
| *Prochlorococcus marinus* MIT 9301 | N | N | N | N |
| *Prochlorococcus marinus* MIT 9303 | Y | N | N | N |
| *Prochlorococcus marinus* MIT 9515 | Y | N | N | N |
| *Prochlorococcus marinus* NATL1A | Y | N | N | N |
| *Pseudoalteromonas* sp. TW-7 | Y | N | Y | Y |
| *Pseudoalteromonas tunicata* D2 | Y | N | Y | Y |
| *Psychroflexus torquis* ATCC 700755 | Y | Y | N | N |
| *Psychromonas* sp. CNPT3 | Y | N | N | Y |
| *Reinekea* sp. MED297 | Y | Y | N | N |
| *Rhodobacterales bacterium* HTCC2150 | Y | Y | Y | N |
| *Rhodobacterales bacterium* HTCC2654 | Y | N | N | N |
| *Rhodobacterales* sp. HTCC2255 | Y | N | Y | N |
| *Roseobacter litoralis* Och 149 | Y | N | N | N |
| *Roseobacter* sp. AzwK-3b | Y | N | N | N |
| *Roseobacter* sp. CCS2 | Y | Y | N | N |
| *Roseobacter* sp. MED193 | Y | N | N | N |
| *Roseobacter* sp. SK209-2-6 | Y | N | Y | N |
| *Roseovarius nubinhibens* ISM | Y | N | N | N |
| *Roseovarius* sp. 217 | Y | Y | Y | Y |
| *Roseovarius* sp. HTCC2601 | Y | N | Y | N |
| *Roseovarius* sp. TM1035 | Y | N | N | N |
| *Sagittula stellata* E-37 | Y | Y | N | N |
| *Shewanella benthica* KT99 | Y | Y | N | Y |
| *Sphingomonas* sp. SKA58 | Y | N | Y | Y |
| *Sulfitobacter* sp. EE-36 | Y | N | N | N |
| *Sulfitobacter* sp. NAS-14.1 | Y | N | N | N |
| *Synechococcus* sp. BL107 | Y | N | N | N |
| *Synechococcus* sp. RS9916 | Y | N | N | N |
| *Synechococcus* sp. RS9917 | Y | N | N | N |
| *Synechococcus* sp. WH 5701 | Y | N | N | N |
| *Synechococcus* sp. WH 7805 | Y | N | N | N |
| *Ulvibacter* sp. SCB49 | Y | Y | N | Y |
| *Vibrio alginolyticus* 12G01 | Y | Y | Y | Y |
| *Vibrio campbellii* AND4 | Y | N | Y | Y |
| *Vibrio harveyi* HY01 | Y | N | Y | Y |
| *Vibrio shilonii* AK1 | Y | Y | Y | Y |
| *Vibrio* sp. MED222 | Y | Y | Y | Y |
| *Vibrio splendidus* 12B01 | Y | Y | Y | Y |
| *Vibrionales bacterium* SWAT-3 | Y | Y | Y | Y |

Incorporation of leucine and other amino acids is routinely used as a proxy for bacterial production in aquatic systems (22) and metatranscriptomic evidence suggests most marine bacterial taxa incorporate amino acids directly (23). As nearly all genomes of marine bacteria (106/110) possess annotated putative amino acid transporters, we expected most of the active microbes in the SF Bay system would incorporate amino acids. Bacterial uptake of single nucleosides (e.g. thymidine) is ubiquitous and used to measure rates of growth (24), but only a few studies have examined longer nucleic acid molecules as a source of carbon or nitrogen for microbial metabolism (see ref. 25 as a recent example). Considering that half (55/110) of fully sequenced marine bacterial genomes contain at least one identified nucleoside transporter or extracellular nuclease, we expected nucleic acid incorporation could be a common phenomenon in the environment. Finally, we also chose to examine fatty acid incorporation because marine bacterial isolates commonly reveal high lipase activity (26), although only 38/110 sequenced bacterial genomes contained identified lipid transporters. In addition, comparative genomics has shown that oligotrophic marine bacterial genomes contain significantly more genes for lipid metabolism and fatty acid degradation than copiotrophic genomes (27). If oligotrophs favor fatty acid incorporation, we hypothesized that it would be less common than amino acid incorporation in our samples since a eutrophic estuary should favor copiotrophs.

In general terms, our results agree with predictions made from available marine genomic data: amino acids were the most commonly incorporated (46 taxa), followed by nucleic acids (32 taxa) and then fatty acids (18 taxa). However, the chip-SIP and genomic data did not always concur. For example, all the *Vibrio* genomes we examined contain putative enzymes for the utilization of the three substrates tested (Table 2), yet chip-SIP indicates the *Vibrio* taxa we detected incorporated only amino acids (FIG. 8A). In this case, genomic potential did not indicate activity. With a relatively high level of taxonomic detail, chip-SIP showed that over 10% of the active taxa in this sample (6 out of 52) did not incorporate amino acid-derived $^{15}N$ into their RNA, even though amino acids are considered a ubiquitous substrate for marine bacteria (22, 23). Indeed, if rates of marine bacterial carbon production based on leucine incorporation are underestimates, this could have significant implications for global carbon modeling efforts. Our analyses also revealed that bacteria commonly incorporate carbon (and presumably nitrogen) from external nucleic acid sources. This complements previous work that identified nucleic acids as a source of phosphorus for marine bacteria, (28). Nucleic acids have C/N ratios lower than phytoplankton-derived organic matter and most amino acids (average C/N of RNA=2.5, POM=6.6, amino acids=3.6). This makes them an ideal resource for bacteria that have relatively high nitrogen requirements. Fatty acids, which contain no nitrogen, were less commonly incorporated than either amino acids or nucleic acids, although we did identify one taxon (uncultivated Alphaproteobacterial clade NAC1-6) that incorporated this substrate but not the others. Such measurements of taxon-specific substrate incorporation within complex communities, along with data gleaned from genomic sequencing, could clearly be useful during the selection of strategies for isolation of previously uncultured microbial taxa.

A frequently accepted, although increasingly controversial view in microbial ecology (29), maintains that 16S phylogeny is closely related to functional role. It is widely assumed that taxa that are closely related by 16S phylogeny are more likely to be functionally similar than to taxa more phylogenetically distant. This concept has been a major assumption of microbial ecology research, without which 16S diversity surveys lose their functional context. Chip-SIP allowed us to test this assumption by matching functional in situ resource use to 16S phylogenetic relationships.

Figure 8B:
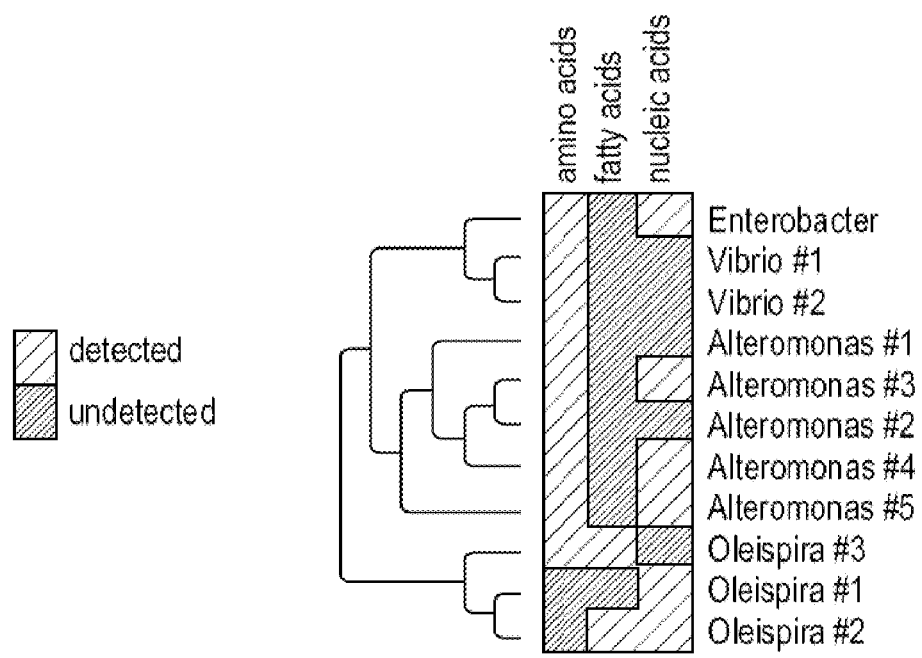
FIG. 8B shows a heat map relationship between substrate incorporation (green=detected, black=not detected) and 16S rRNA phylogeny for a subset of the Gammaproteobacteria, indicating taxa where physiological traits match phylogeny (Alteromonadales and Vibrionaceae) and where they do not (*Oleispira*).

As an example, we mapped substrate utilization data across a subset of the Gammaproteobacterial phylogeny (FIG. 8B) and observed taxon specific responses. For the well characterized and previously cultivated copiotrophic organisms of the genera *Vibrio* and *Alteromonas*, patterns of resource use matched 16S phylogeny quite well: all taxa incorporated amino acids, and several *Alteromonas* taxa incorporated nucleic acids, while no taxon incorporated fatty acids (FIG. 8B). In this case, 16S based phylogeny correlates with resource use. However, in other phylogenetic groups there is a clear decoupling between phylogeny and biogeochemical function. The three taxa identified from the *Oleispira* group exhibited completely different substrate incorporation patterns (FIG. 8B): one incorporated amino acids and fatty acids, the second incorporated only nucleic acids, while the third incorporated both fatty acids and nucleic acids. Based on these data, it would be impossible to predict the resource use of a different *Oleispira* taxon. This decoupling between phylogenetic similarity and measured substrate incorporation illustrates the limitation of using 16S phylogenetic information to predict functional resource utilization.

Based on the success of these initial experiments, chip-SIP may facilitate great strides in our understanding of the functional mechanisms that underlie patterns of microbial diversity. Using this high resolution, high-sensitivity approach, we have revealed patterns of resource utilization in an estuarine community with critical implications for our understanding of carbon cycling in marine environments. These data considerably expand upon previous studies that have identified marine bacterial resource partitioning based on seasonal and small-scale spatial habitat use (30) by adding relative rates of substrate utilization as a critical component of the bacterial niche.

REFERENCES

1. P. Falkowski et al., The global carbon cycle: a test of our knowledge of earth as a system. *Science* 290, 291 (2000).
2. S. J. Giovannoni, U. Stingl, Molecular diversity and ecology of microbial plankton. *Nature* 437, 343 (2005).
3. M. S. Rappé, P. F. Kemp, S. J. Giovannoni, Phylogenetic diversity of marine coastal picoplankton 16S rRNA genes cloned from the continental shelf off Cape Hatteras, N.C. *Limnol. Oceanogr.* 42, 811 (1997).
4. E. F. DeLong et al., Community genomics among stratified microbial assemblages in the ocean's Interior. *Science* 311, 496 (2006).
5. S. Radajewski, P. Ineson, N. R. Parekh, J. C. Murrell, Stable-isotope probing as a tool in microbial ecology. *Nature* 403, 646 (2000).
6. M. Manefield, A. S. Whiteley, R. I. Griffiths, M. J. Bailey, RNA stable isotope probing, a novel means of linking microbial community function to phylogeny. *Appl. Environ. Microbiol.* 68, 5367 (2002).
7. J. Neufeld, M. Wagner, J. Murrell, Who eats what, where and when? Isotope-labelling experiments are coming of age. *ISME J.* 1, 103 (2007).
8. J. C. Murrell, A. S. Whiteley, *Stable isotope probing and related technologies.* (ASM Press, Washington D.C., 2010).
9. M. G. Dumont, J. C. Murrell, Stable isotope probing: linking microbial identity to function. *Nat. Rev. Microbiol.* 3, 499 (2005).
10. O. Uhlik, K. Jecná, M. B. Leigh, M. Macková, T. Macek, DNA-based stable isotope probing: a link between community structure and function. *Sci. Total Environ.* 407, 3611 (2009).
11. S. L. Addison, I. R. McDonald, G. Lloyd-Jones, Stable isotope probing: technical considerations when resolving $^{15}$N-labeled RNA in gradients. *J. Microbiol. Methods* 80, 70 (2010).
12. H. T. S. Boschker et al., Direct linking of microbial populations to specific biogeochemical processes by $^{13}$C-labelling of biomarkers. *Nature* 392, 801 (1998).
13. S. Behrens et al., Linking microbial phylogeny to metabolic activity at the single-cell level by using enhanced element labeling-catalyzed reporter deposition fluorescence in situ hybridization (EL-FISH) and NanoSIMS. *Appl. Environ. Microbiol.* 74, 3143 (2008).
14. C. C. Ouverney, J. A. Fuhrman, Combined microautoradiography-16S rRNA probe technique for determination of radioisotope uptake by specific microbial cell types in situ. *Appl. Environ. Microbiol.* 65, 1746 (1999).
15. J. Adamczyk et al., The isotope array, a new tool that employs substrate-mediated labeling of rRNA for determination of microbial community structure and function. *Appl. Environ. Microbiol.* 69, 6875 (2003).
16. E. L. Brodie et al., Application of a high-density oligonucleotide microarray approach to study bacterial population dynamics during uranium reduction and reoxidation. *Appl. Environ. Microbiol.* 72, 6288 (2006).
17. C. Suttle, J. A. Fuhrman, D. G. Capone, Rapid ammonium cycling and concentration-dependent partitioning of ammonium and phosphate: implications for carbon transfer in planktonic communities. *Limnol. Oceanogr.* 35, 424 (1990).
18. M. S. Rappe, S. A. Connon, K. L. Vergin, S. J. Giovannoni, Cultivation of the ubiquitous SAR11 marine bacterioplankton clade. *Nature* 418, 630 (2002).
19. J. C. Goldman, M. R. Dennett, Ammonium regeneration and carbon utilization by marine bacteria grown on mixed substrates. *Mar. Biol.* 109, 369 (1991).
20. L. R. Pomeroy, P. J. l. Williams, F. Azam, J. E. Hobbie, The microbial loop. *Oceanogr.* 20, (2007).
21. M. J. Fernandez-Reiriz et al., Biomass production and variation in the biochemical profile (total protein, carbohydrates, RNA, lipids and fatty acids) of seven species of marine microalgae. *Aquacult.* 83, 17 (1989).

22. D. Kirchman, E. K'nees, R. Hodson, Leucine incorporation and its potential as a measure of protein synthesis by bacteria in natural aquatic systems. *Appl. Environ. Microbiol.* 49, 599 (1985).
23. R. S. Poretsky, S. Sun, X. Mou, M. A. Moran, Transporter genes expressed by coastal bacterioplankton in response to dissolved organic carbon. *Envir. Microbiol.* 12, 616 (2010).
24. J. A. Fuhrman, F. Azam, Bacterioplankton secondary production estimates for coastal waters of British Columbia, Canada, Antarctica, and California, USA. *Appl. Environ. Microbiol.* 39, 1085 (1980).
25. J. T. Lennon, Diversity and metabolism of marine bacteria cultivated on dissolved DNA. *Appl. Environ. Microbiol.* 73, 2799 (2007).
26. J. Martinez, D. C. Smith, G. F. Steward, F. Azam, Variability in ectohydrolytic enzyme activities of pelagic marine bacteria and its significance for substrate processing in the sea. *Aquat. Microb. Ecol.* 10, 223 (1996).
27. F. M. Lauro et al., The genomic basis of trophic strategy in marine bacteria. *Proc. Natl. Acad. Sci. U.S.A* 106, 15527 (2009).
28. J. W. Ammerman, F. Azam, Bacterial 5-nucleotidase in aquatic ecosystems: a novel mechanism of phosphorus regeneration. *Science* 227, 1338 (1985).
29. W. F. Doolittle, O. Zhaxybayeva, On the origin of prokaryotic species. *Genome Res.* 19, 744 (2009).
30. D. E. Hunt et al., Resource partitioning and sympatric differentiation among closely related bacterioplankton. *Science* 320, 1081 (2008).

REFERENCES FOR EXAMPLE 2

1. R. C. Dugdale, F. P. Wilkerson, V. E. Hogue, A. Marchi, The role of ammonium and nitrate in spring bloom development in San Francisco Bay. *Estuar. Coast. Shelf Sci.* 73, 17 (2007).
2. R. B. Hanson, J. Snyder, Glucose exchanges in a salt marsh estuary: biological activity and chemical measurements. *Limnol. Oceanogr.* 25, 633 (1980).
3. R. Evens, J. Braven, A seasonal comparison of the dissolved free amino acid levels in estuarine and English Channel waters. *Sci. Total Environ.* 76, 69 (1988).
4. T. B. Stauffer, W. G. Macintyre, Dissolved fatty acids in the James River estuary, Virginia, and adjacent ocean waters. *Chesap. Sci.* 11, 216 (1970).
5. M. F. DeFlaun, J. H. Paul, W. H. Jeffrey, Distribution and molecular weight of dissolved DNA in subtropical estuarine and oceanic environments. *Mar. Ecol. Prog. Ser.* 38, 65 (1987).
6. E. L. Brodie et al., Application of a high-density oligonucleotide microarray approach to study bacterial population dynamics during uranium reduction and reoxidation. *Appl. Environ. Microbiol.* 72, 6288 (2006).
7. T. Z. DeSantis et al., Greengenes, a Chimera-Checked 16S rRNA Gene Database and Workbench Compatible with ARB. *Appl. Environ. Microbiol.* 72, 5069 (2006).
8. W. Ludwig et al., ARB: a software environment for sequence data. *Nucl. Acids Res.* 32, 1363 (2004).
9. S. Singh-Gasson et al., Maskless fabrication of light-directed oligonucleotide microarrays using a digital micromirror array. *Nat. Biotech.* 17, 974 (1999).
10. M. S. Cline et al., Integration of biological networks and gene expression data using Cytoscape. *Nat. Protocols* 2, 2366 (2007).

The above examples are provided to illustrate the invention but not to limit its scope. Other variants of the invention will be readily apparent to one of ordinary skill in the art and are encompassed by the appended claims. All publications, databases, and patents cited herein are hereby incorporated by reference for all purposes.

TABLE 1 list of probes specific for laboratory bacterial strains and San Francisco Bay natural community

| SEQUENCE_ID | PROBE_SEQUENCE | SEQUENCE_ID | PROBE_SEQUENCE | SEQUENCE_ID | PROBE SEQUENCE |
|---|---|---|---|---|---|
| Pstutzeri_1 | TAACCGTCCCCCCGAAGGTTAGACT | Vcholerae_1 | AACTTAACCACCTTCCTCCCTACTG | Bcereus_1 | TCCACCTCGCGGTCTTGCAGCTCTT |
| Pstutzeri_2 | GGTAACCGTCCCCCCGAAGGTTAGA | Vcholerae_2 | GTAGGTAACGTCAAATGATTAAGGT | Bcereus_2 | GCCTTTCAATTTCGAACCATGCGGT |
| Pstutzeri_3 | TGGTAACCGTCCCCCCGAAGGTTAG | Vcholerae_3 | TGTAGGTAACGTCAAATGATTAAGG | Bcereus_3 | CTCTTAATCCATTCGCTCGACTTGC |
| Pstutzeri_4 | GTAACCGTCCCCCCGAAGGTTAGAC | Vcholerae_4 | TAACTTAACCACCTTCCTCCCTACT | Bcereus_4 | CCACCTCGCGGTCTTGCAGCTCTTT |
| Pstutzeri_5 | ACTCCGTGGTAACCGTCCCCCCGAA | Vcholerae_5 | ACTTAACCACCTTCCTCCCTACTGA | Bcereus_5 | CTCTGCTCCCGAAGGAGAAGCCCTA |
| Pstutzeri_6 | CACTCCGTGGTAACCGTCCCCCCGA | Vcholerae_6 | TTAACTTAACCACCTTCCTCCCTAC | Bcereus_6 | CCGCCTTTCAATTTCGAACCATGCG |
| Pstutzeri_7 | TCACTCCGTGGTAACCGTCCCCCCG | Vcholerae_7 | TAAGGTATTAACTTAACCACCTTCC | Bcereus_7 | TCTGCTCCCGAAGGAGAAGCCCTAT |
| Pstutzeri_8 | ACCGTCCCCCCGAAGGTTAGACTAG | Vcholerae_8 | CTGTAGGTAACGTCAAATGATTAAG | Bcereus_8 | ACCTGTCACTCTGCTCCCGAAGGAG |
| Pstutzeri_9 | ATCACTCCGTGGTAACCGTCCCCCC | Vcholerae_9 | CTTAACCACCTTCCTCCCTACTGAA | Bcereus_9 | GCTCTTAATCCATTCGCTCGACTTG |
| Pstutzeri_10 | CCGTGGTAACCGTCCCCCCGAAGGT | Vcholerae_10 | ATTAACTTAACCACCTTCCTCCCTA | Bcereus_10 | CGCCTTTCAATTTCGAACCATGCGG |
| Pstutzeri_11 | CTCCGTGGTAACCGTCCCCCCGAAG | Vcholerae_11 | AAGGTATTAACTTAACCACCTTCCT | Bcereus_11 | ACTCTGCTCCCGAAGGAGAAGCCCT |
| Pstutzeri_12 | CCGTCCCCCCGAAGGTTAGACTAGC | Vcholerae_12 | TTAACCACCTTCCTCCCTACTGAAA | Bcereus_12 | GCTCCCGAAGGAGAAGCCCTATCTC |
| Pstutzeri_13 | CCACCACCCTCTGCCATACTCTAGC | Vcholerae_13 | CTTCTGTAGGTAACGTCAAATGATT | Bcereus_13 | TCACTCTGCTCCCGAAGGAGAAGCC |
| Pstutzeri_14 | TCCACCACCCTCTGCCATACTCTAG | Vcholerae_14 | TATTAACTTAACCACCTTCCTCCCT | Bcereus_14 | TCTTAATCCATTCGCTCGACTTGCA |
| Pstutzeri_15 | TTCCACCACCCTCTGCCATACTCTA | Vcholerae_15 | ACGACGTACTTTGTGAGATTCGCTC | Bcereus_15 | CTGCTCCCGAAGGAGAAGCCCTATC |
| Pstutzeri_16 | AATTCCACCACCCTCTGCCATACTC | Vcholerae_16 | TACGACGTACTTTGTGAGATTCGCT | Bcereus_16 | TAATCCATTCGCTCGACTTGCATGT |
| Pstutzeri_17 | AAATTCCACCACCCTCTGCCATACT | Vcholerae_17 | ACTACGACGTACTTTGTGAGATTCG | Bcereus_17 | CACTCTGCTCCCGAAGGAGAAGCCC |
| Pstutzeri_18 | GAAATTCCACCACCCTCTGCCATAC | Vcholerae_18 | CTACGACGTACTTTGTGAGATTCGC | Bcereus_18 | GGTCTTGCAGCTCTTTGTACCGTCC |
| Pstutzeri_19 | ATTCCACCACCCTCTGCCATACTCT | Vcholerae_19 | GACTACGACGTACTTTGTGAGATTC | Bcereus_19 | TGCTCCCGAAGGAGAAGCCCTATCT |
| Pstutzeri_20 | GGAAATTCCACCACCCTCTGCCATA | Vcholerae_20 | AGGTATTAACTTAACCACCTTCCTC | Bcereus_20 | CTTAATCCATTCGCTCGACTTGCAT |
| Pstutzeri_21 | CAGGAAATTCCACCACCCTCTGCCA | Vcholerae_21 | GGTATTAACTTAACCACCTTCCTCC | Bcereus_21 | TTAATCCATTCGCTCGACTTGCATG |
| Pstutzeri_22 | AGGAAATTCCACCACCCTCTGCCAT | Vcholerae_22 | GTATTAACTTAACCACCTTCCTCCC | Bcereus_22 | CTCCCGAAGGAGAAGCCCTATCTCT |
| Pstutzeri_23 | CAGTGTCAGTATTAGCCCAGGTGGT | Vcholerae_23 | CGCGGTATCGCTGCCCTCTGTATAC | Bcereus_23 | GTCACTCTGCTCCCGAAGGAGAAGC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| Pstutzeri_24 | TCAGTATTAGCCCAGGTGGTCGCCT | Vcholerae_24 | TCGCGGTATCGCTGCCCTCTGTATA | Bcereus_24 | CACCTCGCGGTCTTGCAGCTCTTTG |
| Pstutzeri_25 | TCAGTGTCAGTATTAGCCCAGGTGG | Vcholerae_25 | CTTGTCAGTTTCAAATGCGATTCCT | Bcereus_25 | GTCTTGCAGCTCTTTGTACCGTCCA |
| Pstutzeri_26 | TGTCAGTATTAGCCCAGGTGGTCGC | Vcholerae_26 | TTGTCAGTTTCAAATGCGATTCCTA | Bcereus_26 | TGTCACTCTGCTCTGCTCCGAAGAGAAG |
| Pstutzeri_27 | GTCAGTATTAGCCCAGGTGGTCGCC | Vcholerae_27 | GCGGTATCGCTGCCCTCTGTATACG | Bcereus_27 | TCCCGAAGGAGAAGCCCTATCTCTA |
| Pstutzeri_28 | CCTCAGTGTCAGTATTAGCCCAGGT | Vcholerae_28 | CCTGGGCATATCCGGTAGCGCAAGG | Bcereus_28 | CGGTCTTGCAGCTCTTTGTACCGTC |
| Pstutzeri_29 | CTCAGTGTCAGTATTAGCCCAGGTG | Vcholerae_29 | TCCCACCTGGGCATATCCGGTAGCG | Bcereus_29 | TCAAAATGTTATCCGGTATTAGCCC |
| Pstutzeri_30 | ACCTCAGTGTCAGTATTAGCCCAGG | Vcholerae_30 | GGCATATCCGGTAGCGCAAGGCCCG | Bcereus_30 | CCTGTCACTCTGCTCCCGAAGGAGA |
| Pstutzeri_31 | GTGTCAGTATTAGCCCAGGTGGTCG | Vcholerae_31 | ACCTGGGCATATCCGGTAGCGCAAG | Bcereus_31 | TTCAAAATGTTATCCGGTATTAGCC |
| Pstutzeri_32 | AGTGTCAGTATTAGCCCAGGTGGTC | Vcholerae_32 | CTGGGCATATCCGGTAGCGCAAGGC | Bcereus_32 | CACCTGTCACTCTGCTCCCGAAGGA |
| Pstutzeri_33 | CACCTCAGTGTCAGTATTAGCCCAG | Vcholerae_33 | CCCACCTGGGCATATCCGGTAGCGC | Bcereus_33 | TCTTGCAGCTCTTTGTACCGTCCAT |
| Pstutzeri_34 | GCACCTCAGTGTCAGTATTAGCCCA | Vcholerae_34 | TGGGCATATCCGGTAGCGCAAGCC | Bcereus_34 | CTGTCACTCTGCTCCCGAAGGAGAA |
| Pstutzeri_35 | CGCACCTCAGTGTCAGTATTAGCCC | Vcholerae_35 | GGGCATATCCGGTAGCGCAAGGCCC | Bcereus_35 | GCGGTCTTGCAGCTCTTTGTACCGT |
| Pstutzeri_36 | TTCCGCACCTCAGTGTCAGTATTAGC | Vcholerae_36 | GCATATCCGGTAGCGCAAGGCCCGA | Bcereus_36 | CGCGGTCTTGCAGCTCTTTGTACCG |
| Pstutzeri_37 | TCGCACCTCAGTGTCAGTATTAGCC | Vcholerae_37 | CCACCTGGGCATATCCGGTAGCGCA | Bcereus_37 | AGCTCTTAATCATTCGCAGCTCGACTT |
| Pstutzeri_38 | AATGCGTTAGCTGCGCCACTAAGAT | Vcholerae_38 | CATATCCGGTAGCGCAAGGCCCGAA | Bcereus_38 | ACCTGCGGTCTTGCAGCTCTTTGT |
| Pstutzeri_39 | CACACCCCTCTGCCATATCCTAGCT | Vcholerae_39 | CACCTGGGCATATCCGGTAGCGCAA | Bcereus_39 | TCGCGGTCTTGCAGCTCTTTGTACC |
| Pstutzeri_40 | ACACAGGAAATTCACCACACCCTCTG | Vcholerae_40 | ATATCCGGTAGCGCAAGGCCCGAAG | Bcereus_40 | CTCGCGGTCTTGCAGCTCTTTGTAC |
| Pstutzeri_41 | CACAGGAAATTCACCACACCCTCTGC | Vcholerae_41 | TATCCGGTAGCGCAAGGCCCGAAGG | Bcereus_41 | TGCACACCTGTCACTCTGCTCCCG |
| Pstutzeri_42 | ACAGGAAATTCCACCACACCCCTCTGCC | Vcholerae_42 | TCCCCTGCTTTGCTCTTTGCGAGGTT | Bcereus_42 | ATGCACCACCTGTCACTCTGCTCCC |
| Pstutzeri_43 | GAAGTTAGCGCGGTGCTTATTCTGTC | Vcholerae_43 | GTCCCCTGCTTTGCTCTTTGCGAGGT | Bcereus_43 | ACCACCTGTCACTCTGCTCCCCGAAG |
| Pstutzeri_44 | GAAAGTTCTCTGCATGTCAAGGCCT | Vcholerae_44 | CCGAAGGTCCCCTGCTTTGCTCTTTG | Bcereus_44 | GCACCACCTGTCACTCTGCTCCCGA |
| Pstutzeri_45 | AAAGTTCTCTGCATGTCAAGGCCTG | Vcholerae_45 | GGTCCCCTGCTTTGCTCTTTGCGAGG | Bcereus_45 | CACCACCTGTCACTCTGCTCCCGAA |
| Pstutzeri_46 | TCTCTGCATGTCAAGGCCTGGTAAG | Vcholerae_46 | GAAGGTCCCCTGCTTTGCTCTTTGCG | Bcereus_46 | CATAAGAGCAAGCTCTTAATCCATT |
| Pstutzeri_47 | GTTCTCTGCATGTCAAGGCCTGGTA | Vcholerae_47 | AGTCCCCTGCTTTGCTCTTTGCGAG | Bcereus_47 | CCTCGCGGTCTTGCAGCTCTTTGTA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE SEQUENCE |
|---|---|---|---|---|---|
| Pstutzeri_48 | AGTTCTCTGCATGTCAAGGCCTGGT | Vcholerae_48 | CGAAGGTCCCCTGCTTTGCTCTTGC | Bcereus_48 | CCACCTGTCACTCTGCTCCCGAAGG |
| Pstutzeri_49 | AAGTTCTCTGCATGTCAAGGCCTGG | Vcholerae_49 | AAGGTCCCCTGCTTTGCTCTTGCGA | Bcereus_49 | AAGAGCAAGCTCTTAATCATTCGC |
| Pstutzeri_50 | CTCTGCATGTCAAGGCCTGGTAAGG | Vcholerae_50 | CCCCTGCTTTGCTCTTGCGAGGTTA | Bcereus_50 | CGAAGGAGAAGCCCTATCTCTAGGG |
| Pstutzeri_51 | TTCTCTGCATGTCAAGGCCTGGTAA | Vcholerae_51 | TCTAGGGCACAACCTCCAAGTAGAC | Bcereus_51 | AAGTCTTAATCATTCGCTCGACT |
| Pstutzeri_52 | CTGCATGTCAAGGCCTGGTAAGGTT | Vcholerae_52 | CTCTAGGGCACAACCTCCAAGTAGA | Bcereus_52 | TAAGAGCAAGCTCTTAATCATTCG |
| Pstutzeri_53 | TCTGCATGTCAAGGCCTGGTAAGGT | Vcholerae_53 | CCTCTAGGGCACAACCTCCAAGTAG | Bcereus_53 | ATAAGAGCAAGCTCTTAATCATTC |
| Pstutzeri_54 | TACTCACCCGTCCGCCGCTGAATCA | Vcholerae_54 | CGACGTACTTTGTGAGATTCGCTCC | Bcereus_54 | CCCGAAGGAGAAGCCCTATCTCTAG |
| Pstutzeri_55 | CAGCCATGCAGCACCTGTGTCAGAG | Vcholerae_55 | TCAGTTTCAAATGCGATTCCTAGTT | Bcereus_55 | CCGAAGGAGAAGCCCTATCTCTAGG |
| Pstutzeri_56 | ACAGCCATGCAGCACCTGTGTCAGA | Vcholerae_56 | AGTTTCAAATGCGATTCCTAGTTG | Bcereus_56 | CAAGCTCTTAATCATTCGCTCGAC |
| Pstutzeri_57 | GACAGCCATGCAGCACCTGTGTCAG | Vcholerae_57 | TGTCAGTTTCAAATGCGATTCCTAG | Bcereus_57 | AAGGAGAAGCCCTATCTCTAGGGTT |
| Pstutzeri_58 | CTGGAAAGTTCTCTGCATGTCAAGG | Vcholerae_58 | GTTTCAAATGCGATTCCTAGTTGA | Bcereus_58 | GAAGGAGAAGCCCTATCTCTAGGGT |
| Pstutzeri_59 | TGGAAAGTTCTCTGCATGTCAAGGC | Vcholerae_59 | CTAGCTTGTCAGTTTCAAATGCGAT | Bcereus_59 | GCAAGCTCTTAATCATTCGCTCGA |
| Pstutzeri_60 | GGAAAGTTCTCTGCATGTCAAGGCC | Vcholerae_60 | TCTAGCTTGTCAGTTTCAAATGCGA | Bcereus_60 | AGCAAGCTCTTAATCATTCGCTCG |
| eukaryotes_1 | AACTAAGAACGGCCATGCACCACCA | sphingo_1_1 | CCAGCTTGCTGCCCTCTGTACCATC | alpha_7_1 | ACATCTCTGTTTCCGCGACCGGGAT |
| eukaryotes_2 | CACCAACTAAGAACGGCCATGCACC | sphingo_1_2 | CAGCTTGCTGCCCTCTGTACCATCC | alpha_7_2 | CATCTCTGTTTCCGCGACCGGGATG |
| eukaryotes_3 | CCAACTAAGAACGGCCATGCACCAC | sphingo_1_3 | GCCAGCTTGCTGCCCTCTGTACCAT | alpha_7_3 | AAACATCTCTGTTTCCGCGACCGGG |
| eukaryotes_4 | ACCAACTAAGAACGGCCATGCACCA | sphingo_1_4 | TGCCAGCTTGCTGCCCTCTGTACCA | alpha_7_4 | GAAACATCTCTGTTTCCGCGACCGG |
| eukaryotes_5 | CCACCAACTAAGAACGGCCATGCAC | sphingo_1_5 | CAGTTTACGACCCAGAGGGGTGTCT | alpha_7_5 | AGAAACATCTCTGTTTCCGCGACCG |
| eukaryotes_6 | TCCACCAACTAAGAACGGCCATGCA | sphingo_1_6 | AGCAGTTTACGACCCAGAGGGCTGT | alpha_7_6 | AACATCTCTGTTTCCGCGACCGGGA |
| eukaryotes_7 | CAACTAAGAACGGCCATGCACCACC | sphingo_1_7 | AAGCAGTTTACGACCCAGAGGGCTG | alpha_7_7 | ATCTGTTTCCGCGACCGGGATGT |
| eukaryotes_8 | CTCCACCAACTAAGAACGGCCATGC | sphingo_1_8 | GCAGTTTACGACCCAGGCCATGTC | alpha_7_8 | CTGCCACTGTCCACCCGAGCAAGCT |
| eukaryotes_9 | TTGGAGCTGGAATTACCGCGGCTGC | sphingo_1_9 | CCGCTACCTCTAGTGTATTCAAGC | alpha_7_9 | CCACTGTCCACCCGAGCAAGCTCGG |
| eukaryotes_10 | TCAGGCTCCCCTCCGGAATCGAAC | sphingo_1_10 | CATTCCGCCTACCTCTAGTGTATTC | alpha_7_10 | GCCACTGTCCACCCGAGCAAGCTCG |
| eukaryotes_11 | TCTCAGGCTCCCCTCCGGAATCGA | sphingo_1_11 | TGCTGTTGCCAGCTTGCTGCCCTCT | alpha_7_11 | AAACCTCTAGTAGATACCACGCG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| eukaryotes_12 | TATTGGAGCTGGAATTACCGCGGCT | sphingo_1_12 | GCTGTTGCCAGCTTGCTGCCCTCTG | alpha_7_12 | CCAAACCTCTAGGTAGATACCCACG |
| eukaryotes_13 | ATTGGAGCTGGAATTACCGCGGCTG | sphingo_1_13 | TTGCTGTTGCCAGCTTGCTGCCCTC | alpha_7_13 | GTCTGCCACTGTCCACCCGAGCAAG |
| eukaryotes_14 | TAAGAACGGCCATGCACCACCACCC | sphingo_1_14 | CACATTCCGCCTACCTCTAGTGTAT | alpha_7_14 | CCACCCGAGCAAGCTCGGGTTTCTC |
| eukaryotes_15 | CTAAGAACGGCCATGCACCACCACC | sphingo_1_15 | GTCACATTCCGCCTACCTCTAGTGT | alpha_7_15 | TGCCACTGTCCACCCGAGCAAGCTC |
| eukaryotes_16 | ACTAAGAACGGCCATGCACCACCAC | sphingo_1_16 | TCACATTCCGCCTACCTCTAGTGTA | alpha_7_16 | CAAACCTCTAGGTAGATACCCACGC |
| eukaryotes_17 | CTCAGGCTCCCTCTCCGGAATCGAA | sphingo_1_17 | GCTTTCGCTTAGCCGCTAACTGTGT | alpha_7_17 | TCTGCCACTGTCCACCCGAGCAAGC |
| eukaryotes_18 | CTATTGGAGCTGGAATTACCGCGGC | sphingo_1_18 | CGCTTTCGCTTAGCCGCTAACTGTG | alpha_7_18 | CGTCTGCCACTGTCCACCCGAGCAA |
| eukaryotes_19 | AAGAACGGCCATGCACCACCACCCA | sphingo_1_19 | TCGCTTAGCCGCTAACTGTGTATCG | alpha_7_19 | TCCGAACCTCTAGGTAGATTCCCAC |
| eukaryotes_20 | AGGGCTCCCTCTCCGGAATCGAACC | sphingo_1_20 | TTCGCTTAGCCGCTAACTGTGTATC | alpha_7_20 | CACCCGAGCAAGCTCGGGTTTCTCG |
| eukaryotes_21 | CAGGCTCCCTCTCCGGAATCGAACC | sphingo_1_21 | CTTTCGCTTAGCCGCTAACTGTGTA | alpha_7_21 | ACCCGAGCAAGCTCGGGTTTCTCGT |
| eukaryotes_22 | GCTATTGGAGCTGGAATTACCGCGG | sphingo_1_22 | CTGTTGCCAGCTTGCTGCCCTCTGT | alpha_7_22 | CCGTCTGCCACTGTCCACCCGAGCA |
| eukaryotes_23 | TTTCTCAGGCTCCCTCTCCGGAATC | sphingo1_23 | GTTGCCAGCTTGCTGCCCTCTGTAC | alpha_7_23 | CCGAACCTCTAGGTAGATTCCCACG |
| eukaryotes_24 | GGGCTCCCTCTCCGGAATCGAACCCT | sphingo_1_24 | TGTTGCCAGCTTGCTGCCCTCTGTA | alpha_7_24 | AACCTCTAGGTAGATACCCACGCGT |
| eukaryotes_25 | CACTCCACCAACTAAGAACGGCCAT | sphingo_1_25 | CGCTTAGCCGCTAACTGTGTATCGC | alpha_7_25 | TCCACCCGAGCAAGCTCGGGTTTCT |
| archaea_1 | TTGTGGTGCTTCCCCGCCAATTCCT | sphingo_2_1 | TACCGCTACACCCCTCGTTCCGCT | alpha_8_1 | CTGCCACTGTCCACCCGAGCAAGCT |
| archaea_2 | TGCTCCCCCGCCAATTCCTTTAAGT | sphingo_2_2 | GCTATCGGCGTTCTGAGGAATATCT | alpha_8_2 | GCCACTGTCCACCCGAGCAAGCTCG |
| archaea_3 | CGCGCCTGCTGCGCCCGTAGGGC | sphingo_2_3 | CGCTATCGGCGTTCTGAGGAATATC | alpha_8_3 | AAAACCTCTAGGTAGATACCCACGCG |
| archaea_4 | TTTCGGCCTGCTGCGCCCGTAGG | sphingo_2_4 | TCGGCGTTCTGAGGAATATCTATGC | alpha_8_4 | GTCTGCCACTGTCCACCCGAGCAAG |
| archaea_5 | TCGGCCTGCTGCGCCCCGTAGGGC | sphingo_2_5 | TTCACCCGCTACACCCCTCGTTCCGC | alpha_8_5 | CCACCCGAGCAAGCTCGGGTTTCTC |
| archaea_6 | TTCGGCCTGCTGCGCCCGTAGGG | sphingo_2_6 | TTTCACCCGCTACACCCCTCGTTCCG | alpha_8_6 | TGCCACTGTCCACCCGAGCAAGCTC |
| archaea_7 | GTGCTCCCCCGCCAATTCCTTTAAG | sphingo_2_7 | TCGCTTTCGCTTAGCCACTTACTGT | alpha_8_7 | CAAACCTCTAGGTAGATACCCACGC |
| archaea_8 | GCTCCCCCGCCAATTCCTTTAAGTT | sphingo_2_8 | CGGCGTTCTGAGGAATATCTATGCA | alpha_8_8 | TCTGCCACTGTCCACCCGAGCAAGC |
| archaea_9 | GCGCCTGCTGCGCCCCGTAGGGCCT | sphingo_2_9 | AACTAATGGGGGCATGCCCATCCC | alpha_8_9 | ACTGTCCACCCGAGCAAGCTCGGGT |
| archaea_10 | CGCCTGCTGCGCCCCGTAGGGCCTG | sphingo_2_10 | CGCTTAGCCACTTACTGTATATCGC | alpha_8_10 | CCACTGTCCACCCGAGCAAGCTCGG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| archaea_11 | GCCTGCTGCGCCCCGTAGGGCCTGG | sphingo_2_11 | ACTAATGGGGCGCATGCCCATCCCG | alpha_8_11 | CCAAACCTCTAGGTAGATACCCACG |
| archaea_12 | GTTTCGCGCCTGCTGCGCCCCGTAG | sphingo_2_12 | GCCATGCAGCACCTCGTATAGAGTC | alpha_8_12 | GTCCACCCGAGCAAGCTCGGGTTTC |
| archaea_13 | CTTGTGGTGCTCCCCGCCAATTCC | sphingo_2_13 | AGCCATGCAGCACCTCGTATAGAGT | alpha_8_13 | TCCACCCGAGCAAGCTCGGGTTTCT |
| archaea_14 | GGTTTCGCGCCTGCTGCGCCCCGTA | sphingo_2_14 | CAGCCATGCAGCACCTCGTATAGAG | alpha_8_14 | CGTCTGCCACTGTCCACCCGAGCAA |
| archaea_15 | AGGTTTCGCGCCTGCTGCGCCCCGT | sphingo_2_15 | ACAGCCATGCAGCACCTCGTATAGA | alpha_8_15 | TGTCCACCCGAGCAAGCTCGGGTTT |
| archaea_16 | CCTGCTGCGCCCCGTAGGGCCTGGA | sphingo_2_16 | CTTACTTGTCAGCCTACGCACCCTT | alpha_8_16 | ACCCTCTAGGTAGATACCCACGCGTT |
| archaea_17 | CCTTGTGGTGCTCCCCGCCAATTC | sphingo_2_17 | ACTTACTTGTCAGCCTACGCACCCT | alpha_8_17 | CACCCGAGCAAGCTCGGGTTTCTCG |
| archaea_18 | CCCCTTGTGGTGCTCCCCGCCAAT | sphingo_2_18 | CCACTGACTTACTTGTCAGCCTACG | alpha_8_18 | TAAGCCGTCTGCCACTGTCCACCCG |
| archaea_19 | ACCCCTTGTGGTGCTCCCCGCCAA | sphingo_2_19 | CACTGACTTACTTGTCAGCCTACGC | alpha_8_19 | ACCCGAGCAAGCTCGGGTTTCTCGT |
| archaea_20 | CCCTTGTGGTGCTCCCCGCCAATT | sphingo_2_20 | GACTTACTTGTCAGCCTACGCACCC | alpha_8_20 | CCGTCTGCCACTGTCCACCCGAGCA |
| archaea_21 | CACCCCTTGTGGTGCTCCCCGCCA | sphingo_2_21 | TGACTTACTTGTCAGCCTACGCACC | alpha_8_21 | AACCCTCTAGGTAGATACCCACGCGT |
| archaea_22 | GTGTGTGCAAGGAGCAGGGACGTAT | sphingo_2_22 | CTGACTTACTTGTCAGCCTACGCAC | alpha_8_22 | GCCGTCTGCCACTGTCCACCCGAGC |
| archaea_23 | TGTGTGCAAGGAGCAGGGACGTATT | sphingo_2_23 | ACTGACTTACTTGTCAGCCTACGCA | alpha_8_23 | TAGATACCCACGCGTTACTAAGCCG |
| archaea_24 | CGGTGTGCAAGGAGCAGGGACGT | sphingo_2_24 | CCATGCAGCACCTCGTATAGAGTCC | alpha_8_24 | AAGCCCTCTGCCACTGTCCACCCGA |
| archaea_25 | GGTGTGTGCAAGGAGCAGGGACGTA | sphingo_2_25 | CGCTTTCGCTTAGCCACTTACTGTA | alpha_8_25 | GTAGATACCCACGCGTTACTAAGCC |
| bacteria_1 | CGCTCGTTGCGGGACTTAACCCAAC | sphingo_3_1 | AGTTTCCTCGAGCTATGCCCCAGTT | alpha_9_1 | TCTCCGGCGACCAAACTCCCCATGT |
| bacteria_2 | GCTCGTTGCGGGACTTAACCCAACA | sphingo_3_2 | CGAGTTTCCTCGAGCTATGCCCCAG | alpha_9_2 | CGTCTCCGGCGACCAAACTCCCCAT |
| bacteria_3 | GACTTAACCCAACATCTCACGACAC | sphingo_3_3 | GTTTCCTCGAGCTATGCCCCAGTTA | alpha_9_3 | GTCTCCGGCGACCAAACTCCCCATG |
| bacteria_4 | AACCCAACATCTCACGACACGAGCT | sphingo_3_4 | TTTCCTCGAGCTATGCCCCAGTTAA | alpha_9_4 | CTCCGGCGACCAAACTCCCCATGTC |
| bacteria_5 | ACTTAACCCAACATCTCACGACACG | sphingo_3_5 | GAGTTTCCTCGAGCTATGCCCCAGT | alpha_9_5 | GCCGTCTCCGGCGACCAAACTCCCC |
| bacteria_6 | TAACCCAACATCTCACGACACGAGC | sphingo_3_6 | TCGAGTTTCCTCGAGCTATGCCCCA | alpha_9_6 | TCCGGCGACCAAACTCCCCATGTCA |
| bacteria_7 | GGACTTAACCCAACATCTCGCCCTCG | sphingo_3_7 | TTACCGAAGTAAATGCTGCCCCTCG | alpha_9_7 | CCGTCTCCGGCGACCAAACTCCCA |
| bacteria_8 | CTTAACCCAACATCTCACGACACGA | sphingo_3_8 | GTTGCTAGCTCTACCCTAAACAGCG | alpha_9_8 | CGCCGTCTCCGGCGACCAAACTCCC |
| bacteria_9 | TTAACCCAACATCTCACGACACGAG | sphingo_3_9 | AGTTGCTAGCTCTACCCTAAACAGC | alpha_9_9 | CCGGGCGACCAAACTCCCCATGTCAA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| bacteria_10 | GGGACTTAACCCAACATCTCACGAC | sphingo_3_10 | CCATTTACCGAAGTAAATGCTGCCC | alpha_9_10 | ACGCCGTCTCCGGCGACCAAACTCC |
| bacteria_11 | ACTGCTGCCTCCCGTAGGAGTCTGG | sphingo_3_11 | CATTTACCGAAGTAAATGCTGCCCC | alpha_9_11 | GAACTGAAGGACGCCGTCTCCGGCG |
| bacteria_12 | CTCGTTGCGGGACTTAACCCAACAT | sphingo_3_12 | CGCCATTTACCGAAGTAAATGCTGC | alpha_9_12 | CGGCGACCAAACTCCCCTTACGGTCAAG |
| bacteria_13 | CGGGACTTAACCCAACATCTCACGA | sphingo_3_13 | TTGCTAGTCTCTACCCTAAACAGCGC | alpha_9_13 | GTCGGCAGCCTCCCTTACGGGTCGG |
| bacteria_14 | TCGTTGCGGGACTTAACCCAACATC | sphingo_3_14 | GCCATTTACCGAAGTAAATGCTGCC | alpha_9_14 | GGTCGGCAGCCTCCCTTACGGGTCG |
| bacteria_15 | CGTTGCGGGACTTAACCCAACATCT | sphingo_3_15 | TCCTCGAGCTATGCCCCAGTTAAAG | alpha_9_15 | TGGTCGGCAGCCTCCCTTACGGGTC |
| bacteria_16 | GTTGCGGGACTTAACCCAACATCTC | sphingo_3_16 | TTTCCTCGAGCTATGCCCCAGTTAAA | alpha_9_16 | TCGGCAGCCTCCCTTACGGGTCGGC |
| bacteria_17 | TGCGGGACTTAACCCAACATCTCAC | sphingo_3_17 | CAGTTGCTAGTCTCTACCCTAAACAG | alpha_9_17 | GTGGTCGGCAGCCTCCCTTACGGGT |
| bacteria_18 | TTGGGGACTTAACCCAACATCTCA | sphingo_3_18 | TGCTAGTCTCTACCCTAAACAGCGCC | alpha_9_18 | CGTGGTCGGCAGCCTCCCTTACGGG |
| bacteria_19 | CCCCACTGCTGCCTCCCGTAGGAGT | sphingo_3_19 | CCGTCAGATCCTCTCGCAAGAGTAT | alpha_9_19 | CGGCAGCCTCCCTTACGGGTCGGCG |
| bacteria_20 | GCGGGACTTAACCCAACATCTCACG | sphingo_3_20 | CTCGAGCTATGCCCCAGTTAAAGGT | alpha_9_20 | CGCACCTCAGCGTCAGATCCGGACC |
| bacteria_21 | GCGCTCGTTGCGGGACTTAACCCAA | sphingo_3_21 | CCTCGAGCTATGCCCCAGTTAAAGG | alpha_9_21 | AATCTTTCCCCTCCAGGGCTTATCC |
| bacteria_22 | TCCCCACTGCTGCCTCCCGTAGGAG | sphingo_3_22 | CCAGTTGCTAGTCTCTACCCTAAACA | alpha_9_22 | CGAACTGAAGGACGCCGTCTCCGGC |
| bacteria_23 | ATTCCCCACTGCTGCCTCCCGTAGG | sphingo_3_23 | TCTCTCTGGATGTCACTGCATTCT | alpha_9_23 | TACCCCTTCTTCCGATCTCTAGCCTAG |
| bacteria_24 | TTCCCCACTGCTGCCTCCCGTAGGA | sphingo_3_24 | AtCTCTGGATGTCACTGCATTCTGCATTC | alpha_9_24 | GGCAGCCTCCCTTACGGGTCGGCGA |
| bacteria_25 | ACCCAACATCTCACGACACAGAGCTG | sphingo_3_25 | CTCTCTGGATGTCACTGCATTCTA | alpha_9_25 | GGCGACCAAACTCCCCATGTCAAGG |
| rhodobacter_1 | TCCCCAGGCGGAATGCTTAATCCGT | caldithrix_1_1 | ACTCCTCAGAGAGCTTCATCGCCCACG | alpha_10_1 | CGCACCTGAGCGTCAGATCTAGTCC |
| rhodobacter_2 | CTCCCCAGGCGGAATGCTTAATCCG | caldithrix_1_2 | CTCCTCAGAGAGCTTCATCGCCCACGC | alpha_10_2 | TCGCACCTGAGCGTCAGATCTAGTC |
| rhodobacter_3 | ACTCCCCAGGCGGAATGCTTAATCC | caldithrix_1_3 | AACAGGGCTTTACACTCCTCAGAGC | alpha_10_3 | CGTGCGCCACTCTCCAGTTCCCGAA |
| rhodobacter_4 | CCCCAGGCGGAATGCTTAATCCGTT | caldithrix_1_4 | CACTCCTCAGAGAGCTTCATCGCCCAC | alpha_10_4 | CCGTGCGCCACTCTCCAGTTCCCGA |
| rhodobacter_5 | CACCGCGTCATGCTGTTACGCGATT | caldithrix_1_5 | ACAGGGCTTTACACTCCTCAGAGCT | alpha_10_5 | CCCGTGCGCCACTCTCCAGTTCCCG |
| rhodobacter_6 | TCACCGCGTCATGCTGTTACGCGAT | caldithrix_1_6 | ACACTCCTCAGAGAGCTTCATCGCCCA | alpha_10_6 | CTGAGCGTCAGATCTAGTCCAGGTG |
| rhodobacter_7 | ATTCACCGCGTCATGCTGTTACGCG | caldithrix_1_7 | CAGGGCTTTACACTCCTCAGAGCTT | alpha_10_7 | TTCGCACCTGAGCGTCAGATCTAGT |
| rhodobacter_8 | TAGCCCAACCGTAAGGGCCATGAG | caldithrix_1_8 | TCCTCAGAGAGCTTCATCGCCCACGCG | alpha_10_8 | CCAACCGTTATCCCCACTAAGAGAG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE |
|---|---|---|---|
| rhodobacter_9 | TACTCCCCAGGCGGAATGCTTAATC | caldithrix_1_9 | TACACTCCTCAGAGCTTCATCGCCC | alpha_10_9 | TCCAACCGTTATCCCCACTAAGAG |
| rhodobacter_10 | AGCCCAACCCGTAAGGCCATGAGG | caldithrix_1_10 | CTTTCTGGCACTCCCGACTTTCATGG | alpha_10_10 | GCACCTGAGCGTCAGATCAGTCCA |
| rhodobacter_11 | GCCCAACCCGTAAGGGCCATGAGGA | caldithrix_1_11 | TTACACTCCTCAGAGCTTCATCGCC | alpha_10_11 | CCTGAGCGTCAGATCTAGTCCAGGT |
| rhodobacter_12 | AACGTATTCACCGCGTCATGCTGTT | caldithrix_1_12 | CCTCAGAGCTTCATCGCCACGCGG | alpha_10_12 | GTTAGCCCACCGTCTTCGGTAAAA |
| rhodobacter_13 | TTCACCGCGTCATGCTGTTACGCGA | caldithrix_1_13 | CCTAACAGGGCTTTACACTCCTCAG | alpha_10_13 | CCACTAAGAGGTAGGTCCCCACGCG |
| rhodobacter_14 | ACCGCGTCATGCTGTTACGCGATTA | caldithrix_1_14 | AGGGCTTTACACTCCTCAGAGCTTC | alpha_10_14 | TGAGCCTCAGATCTAGTCCAGGTGG |
| rhodobacter_15 | GCGGAATGCTTAATCCGTTAGGTGT | caldithrix_1_15 | TTCTGGCACTCCCGACTTTCATGC | alpha_10_15 | ATCCCCACTAAGAGGTAGGTCCCC |
| rhodobacter_16 | CCAACCCGTAAGGGCCATGAGGACT | caldithrix_1_16 | TCTGGCACTCCCGACTTTCATGGCG | alpha_10_16 | GCTTTCACCCCTGACTGGCAAGACC |
| rhodobacter_17 | CCCAGGCGGAATGCTTAATCCGTTA | caldithrix_1_17 | CTCAGAGCTTCATCGCCACGCGGC | alpha_10_17 | CAACCGTTATCCCCACTAAGAGGT |
| rhodobacter_18 | CCCAACCCGTAAGGGCCATGAGGAC | caldithrix_1_18 | GGGCTTTACACTCCTCAGAGCTTCA | alpha_10_18 | GCGTCACCGAAATCGAAATCCCGAC |
| rhodobacter_19 | AATTCCACTCACCTCTCGAACTC | caldithrix_1_19 | CTCCTAACAGGGCTTTACACTCCTC | alpha_10_19 | TGCGTCACCGAAATCGAAATCCCGA |
| rhodobacter_20 | GAATTCCACTCACCTCTCGAACT | caldithrix_1_20 | CTGGCACTCCCGACTTTCATGGCGT | alpha_10_20 | CGTCACCGAAATCGAAATCCCGACA |
| rhodobacter_21 | TATTCACCGCGTCATGCTGTTACGC | caldithrix_1_21 | TCAGAGCTTCATCGCCACGCGCG | alpha_10_21 | CTGCCACCTGAGCGTCAGATCTAG |
| rhodobacter_22 | ACGTATTCACCGCGTCATGCTGTTA | caldithrix_1_22 | ACCTCTAGACAGTCCCGAAGGAAG | alpha_10_22 | TTTCGCACCTGAGCGTCAGATCTAG |
| rhodobacter_23 | GAACGTATTCACCGCGTCATGCTGT | caldithrix_1_23 | CCCTCTAACAGGGTTTTACACTCC | alpha_10_23 | CTTTCACCCCTGACTGGCAAGACCG |
| rhodobacter_24 | GGAATTCCACTCACCTCTCGAAC | caldithrix_1_24 | GGTCGAAACCTCCAACACACTAGTGC | alpha_10_24 | CTAAAAGGTTAGCCACCGTCTTCG |
| rhodobacter_25 | GTAGCCAACCCGTAAGGCCATGA | caldithrix_1_25 | GTCGAAACCTCCAACACACTAGTGC | alpha_10_25 | CCCACTAAGAGGTAGGTCCCCACGC |
| margrpA_1 | ACGAAGTTAGCCGGTGCTTTCTTGT | chloroflexi_1_1 | TCTCCGAGGAGTCGTTCCAGTTTCC | alpha_12_1 | CCGTGCGCCACTCTATAAATAGCGT |
| margrpA_2 | CACGAAGTTAGCCGGTGCTTTCTTG | chloroflexi_1_2 | CTCCGAGGAGTCGTTCCAGTTTCCC | alpha_12_2 | CCCGTGCGCCACTCTATAAATAGCG |
| margrpA_3 | GTTACTCACCCGTTCGCCAGTTTAC | chloroflexi_1_3 | ACGAATGGGTTTGACACCACCACA | alpha_12_3 | CCAACCGTTATCCCGCAGAAAAAGG |
| margrpA_4 | TAAGGGACATACTGACTTGACATCA | chloroflexi_1_4 | CGAATGGGTTTGACACCACCACCAC | alpha_12_4 | CCCGAGAAAAAGGCAGGTTCCCAC |
| margrpA_5 | ATAAGGGACATACTGACTTGACATC | chloroflexi_1_5 | CTCTCCGAGGAGTCGTTCCAGTTTC | alpha_12_5 | ACCGTTATCCCGCAGAAAAGGCAG |
| margrpA_6 | AAGGGACATACTGACTTGACATCAT | chloroflexi_1_6 | TCCGAGGAGTCGTTCCAGTTTCCT | alpha_12_6 | CAACCGTTATCCCGCAGAAAACGC |
| margrpA_7 | TTACTCACCCGTTCGCCAGTTTACT | chloroflexi_1_7 | GAATGGGTTTGACACCACCACACC | alpha_12_7 | CGTTCAAACCGTTATCCCGCAGAA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| margrpA_8 | CGTTACTCACCCGTTCGCCAGTTTA | chloroflexi_1_8 | GCTCTCCGAGGAGTCGTTCCAGTTT | alpha_12_8 | CCGCAGAAAAGGCAGGTTCCCACG |
| margrpA_9 | GCGTTACTCACCCGTTCGCCAGTTT | chloroflexi_1_9 | CCGAGGAGTCGTTCCAGTTTCCCTT | alpha_12_9 | CGCAGAAAAGGCAGGTTCCCACGC |
| margrpA_10 | CGCGTTACTCACCCGTTCGCCAGT | chloroflexi_1_10 | CGCTCTCCGAGGAGTCGTTCCAGTT | alpha_12_10 | CCGTTATCCCGCAGAAAAGGCAGG |
| margrpA_11 | ACATACTGACTTGACATCATCCCCA | chloroflexi_1_11 | AATGGGTTTGACACCACCACCT | alpha_12_11 | CGTTATCCCGCCACTCTATAAATGC |
| margrpA_12 | TACTGACTTGACATCATCCCCACCT | chloroflexi_1_12 | CGAGGAGTCGTTCCAGTTTCCCTTC | alpha_12_12 | ACCCGTGCGCCACTCTATAAATAGC |
| margrpA_13 | GGACATACTGACTTGACATCATCCC | chloroflexi_1_13 | AGGAGTCGTTCCAGTTTCCCTTCAC | alpha_12_13 | CACCCGTGCGCCACTCTATAAATAG |
| margrpA_14 | GACATACTGACTTGACATCATCCCC | chloroflexi_1_14 | GAGGAGTCGTTCCAGTTTCCCTTCA | alpha_12_14 | TCCCCGAGAAAAGGCAGGTTCCCA |
| margrpA_15 | ATACTGACTTGACATCATCCCCACC | chloroflexi_1_15 | CGCTTTGCGACATGAGCGTCAGGTT | alpha_12_15 | GCAGAAAAGGCAGGTTCCCACGCG |
| margrpA_16 | CATACTGACTTGACATCATCCCCAC | chloroflexi_1_16 | TGAGCGTCAGGTTCAATGCCCAGGT | alpha_12_16 | GGAAACCAAACTCCCCATGTCAAGG |
| margrpA_17 | AGGGACATACTGACTTGACATCATC | chloroflexi_1_17 | ACGCTTTGCGACATGAGCGTCAGT | alpha_12_17 | CCTCCTGCAAGCAGGTTAGCTCACC |
| margrpA_18 | GGGACATACTGACTTGACATCATCC | chloroflexi_1_18 | TCCCCACGCTTTGCGACATGAGCGT | alpha_12_18 | TTTCGCGCCCTCAGCGTCGTCAAATCGG |
| margrpA_19 | ACGCGTTACTCACCCGTTCGCCAGT | chloroflexi_1_19 | TCAGGTTCAATGCCAGGTACCCCT | alpha_12_19 | TTCGCGCCTCAGCGTCAAAATCGGA |
| margrpA_20 | GCACGAAGTTAGCCGGTGCTTTCTT | chloroflexi_1_20 | ATCATCTCGGCCTTCACGTTCGACT | alpha_12_20 | ACTCCCCATGTCAAGGACTGTAAG |
| margrpA_21 | GGCACGAAGTTAGCCGGTGCTTTCT | chloroflexi_1_21 | TGCGACATGAGCGTCAGGTTCAATG | alpha_12_21 | GCCTCCTGCAAGCAGGTTAGCTCAC |
| margrpA_22 | TGGGCACGAAGTTAGCCGGTGCTTT | chloroflexi_1_22 | ATGAGCGTCAGGTTCAATGCCAGGG | alpha_12_22 | CAGAAAAGGCAGGTTCCCCACGCGT |
| margrpA_23 | ACTGACTTGACATCATCCCCACCTT | chloroflexi_1_23 | CACGCTTTGCGACATGAGCGTCAGG | alpha_12_23 | TCCGGCGGACCTTTCTCCGGCGACCTTTC |
| margrpA_24 | CTGGCACGAAGTTAGCCGGTGCTTT | chloroflexi_1_24 | CATGAGCGTCAGGTTCAATGCCAGG | alpha_12_24 | CCCCTCTTTCTCCGGCGGACCTTTC |
| margrpA_25 | ACGATTACTAGCGATTCCTGCTTCA | chloroflexi_1_25 | GTAATCATCTCGGCCTTCAGGTTCG | alpha_12_25 | CCCCTCTTTCTCCGGCGGACCTTTC |
| vibrionaceae_1 | TATCCCCCACATCAGGGCAATTTCC | chloroflexi_2_1 | GGTGACTCCCCTTTCAGGTTGCTAC | alpha_13_1 | TCTAACTGTTCAAGCAGCCTGCGAG |
| vibrionaceae_2 | CGACATTACTCGCTGGCAAACAAGG | chloroflexi_2_2 | AGGTGACTCCCCTTTCAGGTTGCTA | alpha_13_2 | CTAACTGTTCAAGCAGCCTGCGAGC |
| vibrionaceae_3 | CCGACATTACTCGCTGGCAAACAAG | chloroflexi_2_3 | CCCTCCCCATTAAGCGGGGAGATTT | alpha_13_3 | TAACTGTTCAAGCAGCCTGCGAGCC |
| vibrionaceae_4 | CCCCACATCAGGGCAATTTCCTAGG | chloroflexi_2_4 | GCAAGTTGGCTCATCGGTACCGTT | alpha_13_4 | GTCTAACTGTTCAAGCAGCCTGCGA |
| vibrionaceae_5 | CCCCTACATCAGGGCAATTTCCTAG | chloroflexi_2_5 | CTCTCCCGATGTTCCAAGCAAGCTT | alpha_13_5 | CGCTCCTCAGCGTCAGAAATAGCC |
| vibrionaceae_6 | CCCCATCAGGGCAATTTCCTAGGC | chloroflexi_2_6 | CCCCTCCCCATTAAGCGGGGAGATT | alpha_13_6 | GCTCCTCAGCGTCAGAAATAGCCA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| vibrionaceae_7 | CCACATCAGGGCAATTTCCTAGGCA | chloroflexi_2_7 | TTCCAAGCAAGCTTGGCTCATCGGT | alpha_13_7 | TCGCTCCTCAGCGTCAGAAAATAGC |
| vibrionaceae_8 | TCCCCACATCAGGGCAATTTCCTA | chloroflexi_2_8 | AGCAAGCTTGGCTCATCGGTACCGT | alpha_13_8 | CGTCTAACTGTTCAAGCAGCCTGCG |
| vibrionaceae_9 | CCCGACATTACTCGCTGGCAAACAA | chloroflexi_2_9 | ACTCTCCCGATGTTCCAAGCAAGCT | alpha_13_9 | AACTGTTCAAGCAGCCTGCGAGCCC |
| vibrionaceae_10 | ATCCCCCACATCAGGGCAATTTCCT | chloroflexi_2_10 | ACCCCTCCCCATTAAGCGGGAGAT | alpha_13_10 | CACGTCGAACTGTTCAAGCAGCCTG |
| vibrionaceae_11 | TGGTTATCCCCCACATCAGGGCAAT | chloroflexi_2_11 | TCTCCCGATGTTCCAAGCAAGCTTG | alpha_13_11 | ACGTCTAACTGTTCAAGCAGCCTGC |
| vibrionaceae_12 | CCCCCACATCAGGGCAATTTCCCAG | chloroflexi_2_12 | CTCCCGATGTTCCAAGCAAGCTTGG | alpha_13_12 | ACTGTTCAAGCAGCCTGCGAGCCCT |
| vibrionaceae_13 | TCCCCACATCAGGGCAATTTCCCA | chloroflexi_2_13 | AATGACCCCTCCCCATTAAGCGGG | alpha_13_13 | CCGGGGATTTCACGTCTAAGTCTTC |
| vibrionaceae_14 | CCCCACATCAGGGCAATTTCCCAGG | chloroflexi_2_14 | GAATGACCCCTCCCCATTAAGCGG | alpha_13_14 | CTCCTCAGCGTCAGAAAATAGCCAG |
| vibrionaceae_15 | CCCCACATCAGGGCAATTTCCCAGGC | chloroflexi_2_15 | GTTCCAAGCAAGCTTGGCTCATCGG | alpha_13_15 | TTCAAGCAGCCTGCGAGCCCTTTAC |
| vibrionaceae_16 | CACATCAGGGCAATTTCCCAGGCAT | chloroflexi_2_16 | CGAATGACCCCTCCCCATTAAGCGG | alpha_13_16 | TGTTCAAGCAGCCTGCGAGCCCTTT |
| vibrionaceae_17 | CCAATCAGGGCAATTTCCCAGGCA | chloroflexi_2_17 | TGTTCCAAGCAAGCTTGGCTCATCG | alpha_13_17 | CTGTTCAAGCAGCCTGCGAGCCCTT |
| vibrionaceae_18 | ATCCCCCACATCAGGGCAATTTCCC | chloroflexi_2_18 | TCGAATGACCCCTCCCCATTAAGCG | alpha_13_18 | GTTCAAGCAGCCTGCGAGCCCTTTA |
| vibrionaceae_19 | TCCCGACATTACTCGCTGGCAAACA | chloroflexi_2_19 | AAGCAAGCTTGGCTCATCGGTACCG | alpha_13_19 | CGGCATTGCTGGATCAGAGTTGCCT |
| vibrionaceae_20 | GGTTATCCCCCACATCAGGGCAATT | chloroflexi_2_20 | TGACCCCTCCCCATTAAGCGGGGAG | alpha_13_20 | GGCATTGCTGGATCAGAGTTGCCTC |
| vibrionaceae_21 | CGCAAGTTGCCGCCCTCTGTATGC | chloroflexi_2_21 | CCACTCTCCCGATGTTCCAAGCAAG | alpha_13_21 | CGCGGCATTGCTGGATCAGAGTTGC |
| vibrionaceae_22 | GCAAGTTGGCGCGCCCTCTGTATGCG | chloroflexi_2_22 | CCTCCCCATTAAGCGGGAGAGATTTC | alpha_13_22 | GCATTGCTGGATCAGAGTTGCCTCC |
| vibrionaceae_23 | ATGGTTATCCCCCACATCAGGGCAA | chloroflexi_2_23 | CAAGCTTGGCTCATCGGTACCGTTC | alpha_13_23 | GCGGGCATTGCTGGATCAGAGTTGCC |
| vibrionaceae_24 | ACTCGCTGGCAAACAAGGATAAGGG | chloroflexi_2_24 | CCGATGTTCCAAGCAAGCTTGGCTC | alpha_13_24 | CCCGGGGATTTCACGTCTAACTGTT |
| vibrionaceae_25 | CGCATCTGAGTGTCAGTATCTGTCC | chloroflexi_2_25 | CACTCTCCCGATGTTCCAAGCAAGC | alpha_13_25 | ACGCGGCATTGCTGGATCAGAGTTG |
| alteromonadales_1 | CCCCACTTGGGCCAATCTAAAGGCGA | chlorella_pl_1 | CGCCACTCATCGCAATCTGGCAAGC | delta_1_1 | CCGAACTACGAACTGCTTTCTGGA |
| alteromonadales_2 | ATCCCCACTTGGGCCAATCTAAAGGC | chlorella_pl_2 | GCCACTCATCGCAATGTGGCAAGCC | delta_1_2 | TCCGAACTACGAACTGCTTTCTGGG |
| alteromonadales_3 | TCCCACTTGGGCCAATCTAAAGGCG | chlorella_pl_3 | CCACTCATCGCAATCTGGCAAGCCA | delta_1_3 | TTGCTGCGGCACAGCAGGGGTCAAT |
| alteromonadales_4 | CACTTGGGCCAATCTAAAGGCGAG | chlorella_pl_4 | CACTCATCGCAATCTGGCAAGCCAA | delta_1_4 | GTTTGCTGCGGCACACAGCAGGGGTCA |
| altermaonadales_5 | CACTTGGGCCAATCTAAAGGCGAGA | chlorella_pl_5 | GCAAGCCAAATTGCATGAGTACGAC | delta_1_5 | TTTGCTGCGGCACACAGCAGGGGTCAA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| alteromonadales_6 | ACTTTGGGCCAATCTAAAGGCGAGAG | chlorella_p1_6 | GCCAAATTGCATGCGTACGACTTGC | delta_1_6 | TTGCCCAACGACTTCTGGTACAACC |
| alteromonadales_7 | CTTGGGCCAATCAAAGGCGAGAGC | chlorella_p1_7 | TGGCAAGCCAAATTGCATGCGTACG | delta_1_7 | GGTTTGCCCAACGACTTCTGGTACA |
| alteromonadales_8 | CACCTCAAGGCATGTTCCCAAGCAT | chlorella_p1_8 | CTGTGTCCACTCTGGAACTTCCCCT | delta_1_8 | TCCCCGAAGGGTTTGCCCAACGACT |
| alteromonadales_9 | TGAGCGTCAGTGTTGACCCAGGTGG | chlorella_p1_9 | CCGTCCGCCACTCATCGCAATCTGG | delta_1_9 | CCCCGAAGGGTTTGCCCAACGACTT |
| alteromonadales_10 | CGAAGCCCCCTTTGGTCCGTAGACA | chlorella_p1_10 | CCGCCACTCATCGCAATCTGGCAAG | delta_1_10 | CCGAAGGGTTTGCCCAACGACTTCT |
| alteromonadales_11 | ACAGAACCGAGGTTCCGAGCTTCTA | chlorella_p1_11 | CGTCCGCCACTCATCGCAATCTCGC | delta_1_11 | CCCGAAGGGTTTGCCCAACGACTTC |
| alteromonadales_12 | CAGAACCGAGGTTCCGAGCTTCTAG | chlorella_p1_12 | CCTGTGTCCACTCTGGAACTTCCCC | delta_1_12 | CCCGGGCTTTCACACCTGACTTAAA |
| alteromonadales_13 | AGAACCGAGGTTCCGAGCTTCTAGT | chlorella_p1_13 | GTCCGCCACTCATCGCAATCTGGCA | delta_1_13 | GCTTCCTTCAGTGGTACCGTCAACA |
| alteromonadales_14 | GAAAAACAGAACCGAGGTTCCGAGC | chlorella_p1_14 | TCCGCCACTCATCGCAATCTGGCAA | delta_1_14 | AGGGCGCTGCATCCCCGAAGGGTTT |
| alteromonadales_15 | GAACCGAGGTTCCGAGCTTCTAGTA | chlorella_p1_15 | ACCTGTGTCCACTCTGGAACTTCCC | delta_1_15 | GGCGCCTGCATCCCCGAAGGGTTTG |
| alteromonadales_16 | CCGAGGTTCCGAGCTTCTAGTAGAC | chlorella_p1_16 | GGCAAGCCAAATTGCATGCGTACGA | delta_1_16 | GCGCCTGCATCCCCGAAGGGTTTGC |
| alteromonadales_17 | CGAGGTTCCGAGCTTCTAGTAGACA | chlorella_p1_17 | CTGGCAAGCCAAATTGCATGCGTAC | delta_1_17 | GCATCCCCGAAGGGTTTGCCCAACG |
| alteromonadales_18 | AACCGAGGTTCCGAGCTTCTAGTAG | chlorella_p1_18 | CCCGTCCGCCACTCATCGCAATCTG | delta_1_18 | ATCCCCGAAGGGTTTGCCCAACGAC |
| alteromonadales_19 | ACCGAGGTTCCGAGCTTCTAGTAGA | chlorella_p1_19 | CACCTGTGCCACTCTGGAACTTTCC | delta_1_19 | CATCCCCGAAGGGTTTGCCCAACGA |
| alteromonadales_20 | AACAGAACCGAGGTTCCGAGCTTCT | chlorella_p1_20 | ACCCGTCCGCCACTCATCGCAATCT | delta_1_20 | ACCTTAGGCGCCTGCATCCCCGAAG |
| alteromonadales_21 | AAACAGAACCGAGGTTCCGAGCTTC | chlorella_p1_21 | CCACCTGTGTCCACTCTGGAACTTC | delta_1_21 | CCTTAGGCGCCTGCATCCCCGAAGG |
| alteromonadales_22 | CCGAAGCCCCCTTTGGTCCGTAGAC | chlorella_p1_22 | CACCCGTCCGCCACTCATCGCAATC | delta_1_22 | TACCTTAGGCGCCTGCATCCCCGAA |
| alteromonadales_23 | GAAGCCCCCTTTGGTCCGTAGACAT | chlorella_p1_23 | TCACCCGTCCGCCACTCATCGCAAT | delta_1_23 | ATACCTTAGGCGCCTGCATCCCCGA |
| alteromonadales_24 | AAGCCCCCTTTGGTCCGTAGACATT | chlorella_p1_24 | ACCACCTGTGTCCACTCTGGAACTT | delta_1_24 | CTTAGGCGCCTGCATCCCCGAAGGG |
| alteromonadales_25 | CCACCTCAAGGCATGTTCCCAAGCA | chlorella_p1_25 | CACCACCTGTGTCCACTCTGGAACT | delta_1_25 | CATACCTTAGGCGCCTGCATCCCCG |
| polaribacters_1 | GCCAGATGGCTGCTCATTGTCCATA | plastid_1_1 | GGTCTCACGACTTGGCATCTCATTG | delta_2_1 | CTCCAGTCTTTCGATAGGATTCCCG |
| polaribacters_2 | TGCCAGATGGCTGCTCATTGTCCAT | plastid_1_2 | TCTCCCTAGGCAGGTTTTTGACCTG | delta_2_2 | GGCCACCCTTGATCCAAAAACCCGA |
| polaribacters_3 | TTGCCAGATGGCTGCTCATTGTCCA | plastid_1_3 | CCACGTGGATTCGATACACGCAATG | delta_2_3 | AGGCCACCCTTGATCCAAAAACCCG |
| polaribacters_4 | CCAGATGGCTGCTCATTGTCCATAC | plastid_1_4 | ATGCACCACCTGTATGTGTCTGCCG | delta_2_4 | AAGGGCACTCCAGTCTTTCGATAGG |

TABLE 1-continued list of probes specific for laboratory bacterial strains and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| polaribacters_5 | GTTGCCAGATGGCTGCTCATTGTCC | plastid_1_5 | CACCACCTGTATGTGTCTGCCGAAG | delta_2_5 | GAGGCCACCCTTGATCCAAAAACCC |
| polaribacters_6 | TCCCTCAGCGTCAGTACATACGTAG | plastid_1_6 | AACACCACGTGGATTCGATACACGC | delta_2_6 | GAAGGGCACTCCAGTCTTTCGATAG |
| polaribacters_7 | CCCTCAGCGTCAGTACATACGTAGT | plastid_1_7 | ACCACCTGTATGTGTCTGCCGAAGC | delta_2_7 | ACCCTAGCAAGCTAGAGTGTTCTCG |
| polaribacters_8 | GTCCCTCAGCGTCAGTACATACGTA | plastid_1_8 | CTTCTCCCTAGGCAGGTTTTTGACC | delta_2_8 | AGAGGCCACCCTTGATCCAAAAACC |
| polaribacters_9 | CAGATGGCTGCTCATTGTCCATACC | plastid_1_9 | TGCACCACCTGTATGTGTCTGCCGA | delta_2_9 | AGAGGCCACCCTTGATCCAAAAACC |
| polaribacters_10 | TTCGCATAGTGGCTGCTCATTGTCC | plastid_1_10 | ACACCACCTGGATTCGATACACCCA | delta_2_10 | ACATGTAGAGGCCACCCTTGATCCA |
| polaribacters_11 | CGTCCCTCAGCGTCAGTACATACGT | plastid_1_11 | CCACCTGTATGTGTCTGCCGAAGCA | delta_2_11 | TACATGTAGAGGCCACCCTTGATCC |
| polaribacters_12 | AGACCCCTACCTATCGTTGCCATG | plastid_1_12 | GCACCACCTGTATGTGTCTGCCGAA | delta_2_12 | CCCCGAAGGGCACTCCAGTCTTTCG |
| polaribacters_13 | CGCTTAGTCACTGAGCTAATGCCCA | plastid_1_13 | CACCACGTGGATTCGATACACGCAA | delta_2_13 | CCCTAGCAAGCTAGAGTGTTCTCGT |
| polaribacters_14 | TGTTGCCAGATGGCTGCTCATTGTC | plastid_1_14 | CTCACGACTTGGCATCAGAAACTTCC | delta_2_14 | GCTTACATGTAGAGGCCACCCTTGA |
| polaribacters_15 | GATTCGCTCCTATTCGCATAGTGGC | plastid_1_15 | CAGGTACACGTCAGAGTTTTTGACCGT | delta_2_15 | GGGCACTCCAGTCTTTCGATAGGAT |
| polaribacters_16 | TCGTCCCTCAGCGTCAGTACATACG | plastid_1_16 | CTCCCTAGGCAGGTTTTTGACCTGT | delta_2_16 | CCGAAGGGCACTCCAGTCTTTCGAT |
| polaribacters_17 | TCGTTAGTCACTGAGCTAATGCCC | plastid_1_17 | CGTTCTCACGACTTGGCATCATT | delta_2_17 | CGAAGGGCACTCCAGTCTTTCGATA |
| polaribacters_18 | TCGCATAGTGGCTGCTCATTGTCCA | plastid_1_18 | GACCAACTACTGATCGTCACCTTGG | delta_2_18 | AGGGGCACTCCAGTCTTTCGATAGGA |
| polaribacters_19 | CAGACCCCCTACCTATCGTTGCCAT | plastid_1_19 | GTTCTCCCTAGGCAGGTTTTTGAC | delta_2_19 | CCCGAAGGGCACTCCAGTCTTTCGA |
| polaribacters_20 | TTCGTCCCTCAGCGTCAGTACATAC | plastid_1_20 | CACCTGTATGTGTCTGCCGAAGCAC | delta_2_20 | CCAGTCTTTCGATAGGATTCCCGGG |
| polaribacters_21 | CTCTCTGTTGCCAGATGGCTGCTCA | plastid_1_21 | CTGTATGTGTCTGCCGAAGCACTTC | delta_2_21 | TCCAGTCTTTCGATAGGATTCCCGG |
| polaribacters_22 | GCAGATTCTATACGCGTTACGCACC | plastid_1_22 | CATGCACACCTGTATGTGTCTGCC | delta_2_22 | GTCTTTTCGATAGGATTCCCGGGATG |
| polaribacters_23 | GGCAGATTCTATACGCGTTACGCAC | plastid_1_23 | AGGTACACGTCAGAACTTCCTCCC | delta_2_23 | CTTTCGATAGGATTCCCGGGATGTC |
| polaribacters_24 | CACCTCTGACTTAATTGACCGCCTG | plastid_1_24 | TCGGTCTCACGACTTGGCATCTCAT | delta_2_24 | CAGTCTTTCGATAGGATTCCCGGGA |
| polaribacters_25 | CCTTCTGACTTAATTGACCGCCTGCG | plastid_1_25 | CCTTCTACTTCGACTTCTACTCCGAGC | delta_2_25 | GGGCTCCCCGAAGGGCACTCCAGTC |
| desulfovibrionales_1 | CCCGAGCATGCTGATCTCGAATTAC | plastid_2_1 | CAGGTAACGTCAGAACTTCCTCCCT | delta_31 | GGCACAGAAAGGGTCAACACTTCCT |
| desulfovibrionales_2 | CACCCGAGCATGCTGATCTCGAATT | plastid_2_2 | AGGTAACGTCAGAACTTCCTCCCTG | delta_3_2 | TCGGCACAGAAAGGTCAACACTTC |
| desulfovibrionales_3 | TCACCCGAGCATGCTGATCTCGAAT | plastid_2_3 | GGTAACGTCAGAACTTCCTCCCTGA | delta_3_3 | CGGCACAGAAAGGGTCAACACTTCC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| desulfovibrionales_4 | TTCACCCGAGCATGCTGATCTCGAA | plastid_2_4 | TCAGGTAACGTCAGAACTTCCTCCC | delta_3_4 | CTTCGGCACAGAAAGGGTCAACACT |
| desulfovibrionales_5 | GCACCCTCTAATTTCCTAGAGGTCC | plastid_2_5 | CGCGTTAGCTATAATACCGCATGGG | delta_3_5 | CACTTTACTCTCCCGACGAATCGGA |
| desulfovibrionales_6 | AGGGCACCCTCTAATTTCCTAGAGG | plastid_2_6 | AATACCGCATGGGTCGATACATGCG | delta_3_6 | CCACTTTACTCTCCCGACGAATCGG |
| desulfovibrionales_7 | GGGCACCCTCTAATTTCCTAGAGGT | plastid_2_7 | CTGTATGTACGTTCCCGAAGGTGGT | delta_3_7 | GCTTCGGCACAGAAAGGGTCAACAC |
| desulfovibrionales_8 | CCCTCTAATTTCCTAGAGGTCCCCT | plastid_2_8 | CCTGTATGTACGTTCCCGAAGGTGG | delta_3_8 | CTCTCCCGACGAATCGGAATTTCTC |
| desulfovibrionales_9 | ACCCTCTAATTTCCTAGAGGTCCCC | plastid_2_9 | TCAGCCGCGAGCTCCTCTCTAGGCA | delta_3_9 | CCGACGAATCGGAATTTCTCGTTCG |
| desulfovibrionales_10 | ATTTCCTAGAGGTCCCCTGATGTC | plastid_2_10 | ATACCGCATGGGTCGATACATGCGA | delta_3_10 | GCCACTTTACTCTCCCGACGAATCG |
| desulfovibrionales_11 | AGGGTACCGTCAAATGCCTACCCTA | plastid_2_11 | ACCTGTATGTACGTTCCCGAAGGTG | delta_3_11 | AGCTTCGGCACAGAAAGGGTCAACA |
| desulfovibrionales_12 | GAGGGTACCGTCAAATGCCTACCCT | plastid_2_12 | GCCGCGAGCTCCTCTCTAGGCAGAA | delta_3_12 | ACTCTCACGAGTTCGCTACCCTTTG |
| desulfovibrionales_13 | GGGTACCGTCAAATGCCTACCCTAT | plastid_2_13 | GCGCCTTCCTCCAAACGGTTAGAAT | delta_3_13 | TCTCCCGACGAATCGGAATTTCTCG |
| desulfovibrionales_14 | TTTCCTAGAGGTCCCCTGATGTCA | plastid_2_14 | AGCCGCGAGCTCCTCTCTAGGCAGA | delta_3_14 | TAGCTTCGGCACAGAAAGGGTCAAC |
| desulfovibrionales_15 | TTCCTAGAGGTCCCCTGATGTCAA | plastid_2_15 | CAGCCGCGAGCTCCTCTCTAGGCAG | delta_3_15 | CTCTCACGAGTTCGCTACCCTTTGT |
| desulfovibrionales_16 | TGAGGGTACCGTCAAATGCCTACCC | plastid_2_16 | CACCTGTATGTACGTTCCCGAAGGT | delta_3_16 | GTGCTGGTTACACCCGAAGGCAATC |
| desulfovibrionales_17 | CTCTAATTTCCTAGAGGTCCCCTGG | plastid_2_17 | AATCAGCCGCGAGCTCCTCTCTAGG | delta_3_17 | CGCCACTTTACTCTCCCGACGAATC |
| desulfovibrionales_18 | CACCCTCTAATTTCCTAGAGGTCCC | plastid_2_18 | TAATCAGCCGCGAGCTCCTCTCTAG | delta_3_18 | CTCCCGACGAATCGGAATTTCTCGT |
| desulfovibrionales_19 | GGCACCCTCTAATTTCCTAGAGGTC | plastid_2_19 | ATCAGCCGCGAGCTCCTCTCTAGGC | delta_3_19 | CTTACTCTCACGAGTTCGCTACCCT |
| desulfovibrionales_20 | CCCTCTAATTTCCTAGAGGTCCCTG | plastid_2_20 | GGCGCCTTCCTCCAAACGGTTAGAA | delta_3_20 | TGTGCTGGTTACACCCGAAGGCAAT |
| desulfovibrionales_21 | CAACCGTTATCCCGTTCTTGAAGGT | plastid_2_21 | CCGGAGCTCCTCTCTAGGCAGAAA | delta_3_21 | CTCACGAGTTCGCTACCCTTTGTAC |
| desulfovibrionales_22 | ATCAAAGGCTGTTCCACCGTTGAGC | plastid_2_22 | GCATGGGTCGATACATGCGACATCT | delta_3_22 | CTGTGCTGGTTACACCCGAAGGCAA |
| desulfovibrionales_23 | TTGCTCGTTAGCTCGCCGGCTTCGG | plastid_2_23 | CCGCATGGGTCGATACATGCGACAT | delta_3_23 | TCGCCACTTTACTCTCCCGACGAAT |
| desulfovibrionales_24 | ATTGCTCGTTAGCTCGCCGGCTTCG | plastid_2_24 | TACCGCATGGGTCGATACATGCGAC | delta_3_24 | CCTGTGCTGGTTACACCCGAAGGCA |
| desulfovibrionales_25 | CCTAGAGGTCCCCTGGATGTCAAGC | plastid_2_25 | ACCGCATGGGTCGATACATGCGACA | delta_3_25 | GCTTACTCTCACGAGTTCGCTACCC |
| aquaficae_1 | AACCAGACGCTCCACCGGTTGTGCC | plastid_3_1 | CACCGTCGTATATCTGACCGACGAT | altero_1_1 | CCCACTTGGGCCAATCAATCTAAAGGCGA |
| aquaficae_2 | ACCAGACGCTCCACCGGTTGTGCCG | plastid_3_2 | TTCACCGTCGTATATCTGACCGACG | altero_1_2 | ATCCCACTTGGGCCAATCAATCTAAAGGC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| aquaficae_3 | AAACCAGACGCTCCACCGGTTGTGC | plastid_3_3 | TCACCGTCGTATATCTGACCGACGA | altero_1_3 | TCCCACTTGGGCCAATCTAAAGGCG |
| aquaficae_4 | TGCCACTGTAGCGCCTGTGTAGCCC | plastid_3_4 | GTAGCCGAGTTTCAGGCTACAATCC | altero_1_4 | CCACTTGGGCCAATCTAAAGGCGAG |
| aquaficae_5 | TAAACCAGACGCTCCACCGGTTGTG | plastid_3_5 | TAGCCGAGTTTCAGGCTACAATCCG | altero_1_5 | CACTTGGGCCAATCTAAAGGCGAGA |
| aquaficae_6 | GCCACTGTAGCGCCTGTGTAGCCCA | plastid_3_6 | GACCTCATCCTCACCTTCCTCCAAT | altero_1_6 | ACTTGGGCCAATCTAAAGGCGAGAG |
| aquaficae_7 | CCAGACGCTCCACCGGTTGTGCGGG | plastid_3_7 | AGCCGAGTTTCAGGCTACAATCCGA | altero_1_7 | CTTGGGCCAATCTAAAGGCGAGAGC |
| aquaficae_8 | CCACTGTAGCGCCTGTGTAGCCCAG | plastid_3_8 | GCCGAGTTTCAGGCTACAATCCGAA | altero_1_8 | CTGTCAGTAACGTCACAGCTAGCAG |
| aquaficae_9 | GCATAAAGGGCATACTGACCTGACG | plastid_3_9 | CCGAGTTTCAGGCTACAATCCGAAC | altero_1_9 | ACAGAACCGAGGTTCCGAGCTTCTA |
| aquaficae_10 | TTAAACCAGACGCTCCACCGGTTGT | plastid_3_10 | CTCCCGTAGGAGTCTGTTCCGTTCT | altero_1_10 | CAGAACCGAGGTTCCGAGCTTCTAG |
| aquaficae_11 | CATTGCCCACGATTCCCCACTGCTG | plastid_3_11 | CCTTCCCGTAGGAGTCTGTTCCGTTC | altero_1_11 | AGAACCGAGGTTCCGAGCTTCTAGT |
| aquaficae_12 | ATTGCCCACGATTCCCCACTGCTGC | plastid_3_12 | TCCCGTAGGAGTCTGTTCCGTTCTA | altero_1_12 | GAAAAACAGAACCGAGGTTCCGAGC |
| aquaficae_13 | CCATTGCCCACGATTCCCCACTGCT | plastid_3_13 | CCCGTAGGAGTCTGTTCCGTTCTAA | altero_1_13 | GAACCGAGGTTCCGAGCTTCTAGTA |
| aquaficae_14 | GCCCATTGCCCACGATTCCCCACTG | plastid_3_14 | TGACCTCATCCTCACCTTCCTCCAA | altero_1_14 | CCGAGGTTCCGAGCTTCTAGTAGAC |
| aquaficae_15 | CCCCATTGCCCACGATTCCCCACTG | plastid_3_15 | CTAAAGCATTCATCCTCCACGCGGT | altero_1_15 | CGAGGTTCCGAGCTTCTAGTAGACA |
| aquaficae_16 | CGCCCATTGCCACGATTCCCCACT | plastid_3_16 | CCTAAAGCATTCATCCTCCACGCGG | altero_1_16 | AACCGAGGTTCCGAGCTTCTAGTAG |
| aquaficae_17 | TGCCCACGATTCCCCACTGCTGCCC | plastid_3_17 | CCCTAAAGCATTCATCCTCCACGCG | altero_1_17 | ACCGAGGTTCCGAGCTTCTAGTAGA |
| aquaficae_18 | ATTAAACCAGACGCTCCACCGGTTG | plastid_3_18 | ACCCTAAAGCATTCATCCTCCACGC | altero_1_18 | AACAGAACCGAGGTTCCGAGCTTCT |
| aquaficae_19 | TTGCCCACGATTCCCCACTGCTGCC | plastid_3_19 | ACATAAGGGCATGCTGACTTGACC | altero_1_19 | AAACAGAACCGAGGTTCCGAGCTTC |
| aquaficae_20 | GCCCACGATTCCCCACTGCTGCCCC | plastid_3_20 | GTTCCGTTCTAAATCCCAGTGTGGC | altero_1_20 | CCAACTGTTGTCCCCACCTCAAGG |
| aquaficae_21 | CAGACGCTCCACCGGTTGTGCGGGC | plastid_3_21 | CATAAGGGCATGCTGACTTGACCT | altero_1_21 | CCGGACTACGACGCACTTAAGTGA |
| aquaficae_22 | GGCATAAAGGGCATACTGACCTGAC | plastid_3_22 | GCGGTATTGCTTGGTCAAGCTTTCG | altero_1_22 | TGGGCCAATCTAAAGGCGAGAGCCG |
| aquaficae_23 | GCAGTTCGGAATGCCTTGCCGAAGT | plastid_3_23 | CGGTATTGCTTGGTCAAGCTTTCGC | altero_1_23 | GGGCCAATCTAAAGGCGAGAGCCGA |
| aquaficae_24 | CAGTTCGGAATGCCTTGCCGAAGTT | plastid_3_24 | CACGCGGTATTGCTTGGTCAAGCTT | altero_1_24 | TTGGGCCAATCTAAAGGCGAGAGCC |
| aquaficae_25 | CGCAGTTCGGAATGCCTTGCCGAAG | plastid_3_25 | CATCCTCCACGCGGTATTGCTTGGT | altero_1_25 | GGTTCCGAGCTTCTAGTAGACATCG |
| bacilli_1 | CACTCTGCTCCGAGGAGGAGAAGCCC | plastid_4_1 | CTTAAGCGCCGCCCTCCGAATGTT | altero_2_1 | TCTCACTTGGGCCTCTCTTGCGCC |

TABLE 1-continued list of probes specific for laboratory bacterial strains and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| bacilli_2 | GTCACTCTGCTCCCGAAGGAGAAGC | plastid_4_2 | CCTTAAGCGCCCCTTCCGAATGGT | altero_2_2 | CCCCTCGCAAAGGCAAGTTCCCAAG |
| bacilli_3 | CTGCTCCCGAAGGAGAAGCCCTATC | plastid_4_3 | TACCTTAAGCGCCGCCCTCCGAATG | altero_2_3 | CCCTCGCAAAGGCAAGTTCCCAAGC |
| bacilli_4 | TCACTCTGCTCCCGAAGGAGAAGCC | plastid_4_4 | ACCTTAAGCGCCGCCCTCCGAATGG | altero_2_4 | TCACTTGGGCCTCTCTCTTTGCGCCGG |
| bacilli_5 | TCTGCTCCCGAAGGAGAAGCCCTAT | plastid_4_5 | AGCCCTACCTTAAGCGCCCCTCC | altero_2_5 | CTTGGGCCTCTCTCTTTGCGCCGAGC |
| bacilli_6 | TGCTCCCGAAGGAGAAGCCCTATCT | plastid_4_6 | TTAAGCGCCGCCCTCCGAATGGTTA | altero_2_6 | CGACATTCTTTAAGGGGTCCGCTCC |
| bacilli_7 | CTCTGCTCCCGAAGGAGAAGCCCTA | plastid_4_7 | TAAGCGCCGCGCCCTCCGAATGGTTAG | altero_2_7 | CACTTGGGCCTCTCTCTTTGCGCCGGA |
| bacilli_8 | GCTCCCGAAGGAGAAGCCCTATCTC | plastid_4_8 | TAGCCCTACCTTAAGCGCCGCCTC | altero_2_8 | CTCTGGGCCTCTCTCTTTGCGCCGAG |
| bacilli_9 | ACTCTGCTCCCGAAGGAGAAGCCCT | plastid_4_9 | CTACCTTAAGCGCCGCCCCTCCGAAT | altero_2_9 | ACTTGGGCCTCTCTCTTTAAGGGTCCGC |
| bacilli_10 | CCGAAGCCGCCTTTCAATTTCGAAC | plastid_4_10 | GCCCTACCTTAAGCGCCGCCCTCCG | altero_2_10 | CTACGACATTCTTTAAGGGGTCCGC |
| bacilli_11 | CGTCCGCCGCTAACTTCATAAGAGC | plastid_4_11 | CCCTACCTTAAGCGCCGCCCTCCGA | altero_2_11 | CCGGACTACGACATTCTTTAAGGGG |
| bacilli_12 | GTCCGCCGCTAACTTCATAAGAGCA | plastid_4_12 | CCTACCTTAAGCGCCGCCCTCCGAA | altero_2_12 | ATCTCACTTGGGCCTCTCTTTGCGC |
| bacilli_13 | CCGCCGCTAACTTCATAAGAGCAAG | plastid_4_13 | CTAGCCCTACCTTAAGCGCCGCCCT | altero_2_13 | CCCCCTCGCAAAGGCAAGTTCCCAA |
| bacilli_14 | AGCCGAAGCCGCCTTTCAATTTCGA | plastid_4_14 | ACTAGCCCTACCTTAAGCGCCGCCC | altero_2_14 | ACATTCTTTAAGGGGTCCGCTCCAC |
| bacilli_15 | CTCCGAAGGAGAAGCCCTATCTCT | plastid_4_15 | AAGCGCCGCCCTCCGAATGGTTAGG | altero_2_15 | TTGGGCCTCTCTCTTTGCGCCGAGCC |
| bacilli_16 | CAGCCGAAGCCGCCTTTCAATTTCG | plastid_4_16 | CACTAGCCCTACCTTAAGCGCCGCC | altero_2_16 | TCCCCCTCGCAAAGGCAAGTTCCCA |
| bacilli_17 | CTGTCACTCTGCTCCCGAAGGAGAA | plastid_4_17 | CGCCGCCCTCCGAATGGTTAGCGCT | altero_2_17 | CCTCGCAAAGGCAAGTTCCCAAGCA |
| bacilli_18 | GCCGAAGCCGCCTTTCAATTTCGAA | plastid_4_18 | GGGCCGCCCTCCGAATGGTTAGGCT | altero_2_18 | GGGTCCGCTCCACATCACTGTCTCG |
| bacilli_19 | CCCGTCCGCCGCTAACTTCATAAGA | plastid_4_19 | GCCGCCCTCCGAATGGTTAGGCTAA | altero_2_19 | ACGACATTCTTTAAGGGGTCCGCTC |
| bacilli_20 | CCGTCCGCCGCTAACTTCATAAGAG | plastid_4_20 | AGCGCCGCCCTCCGAATGGTTAGGC | altero_2_20 | CATTCTTTAAGGGGTCCGCTCCACA |
| bacilli_21 | CGCCCTAACTTCATAAGAGCAAGC | plastid_4_21 | ACGAGATTAGCTAGCCTTCGCAGGT | altero_2_21 | GACATTCTTTAAGGGGTCCGCTCCA |
| bacilli_22 | CCCGAAGGAGAAGCCCTATCTCTAG | plastid_4_22 | CCGCCCTCCGAATGGTTAGGCTAAC | altero_2_22 | AATCTCACTTGGGCCTCTCTTTGCG |
| bacilli_23 | CGAAGGAGAAGCCCTATCTCTAGGG | plastid_4_23 | CGCCCTCCGAATGGTTAGGCTAACG | altero_2_23 | TAAGGGGTCCGCTCCACATCACTGT |
| bacilli_24 | CCGAAGGAGAAGCCCTATCTCTAGG | plastid_4_24 | GCCCTCCGAATGGTTAGGCTAACGA | altero_2_24 | ATCCCCCTCGCAAAGGCAAGTTCCC |
| bacilli_25 | TGTCACTCTGCTCCCGAAGGAGAAG | plastid_4_25 | TCACTAGCCCTACCTTAAGCGCCGC | altero_2_25 | GGTCCGCTCCACATCACTGTCTCGC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| crenarch_1_1 | AGCCTGTACGTTGAGCGTACAGATT | plastid_5_1 | CTCTACCCCTACCATACTCAAGCCT | colwel_1_1 | TGCGCCACTCACGGATCAAGTCCAC |
| crenarch_1_2 | CCTGTACGTTGAGCGTACAGATTTA | plastid_5_2 | GACGTCGTCCTCCAAATGGTTAGAC | colwel_1_2 | CTGCGCCACTCACGGATCAAGTCCA |
| crenarch_1_3 | GCCTGTACGTTGAGCGTACAGATTT | plastid_5_3 | CCTTAGCGTCGTCCTCCAAATGT | colwel_1_3 | GCTGCGCCACTCACGGATCAAGTCC |
| crenarch_1_4 | GAGCGTACAGATTTAACCGAAAACT | plastid_5_4 | ACCTTAGACGTCGTCCTCCAAATGG | colwel_1_4 | TAGCTGCGCCACTCACGGATCAAGT |
| crenarch_1_5 | TGAGCGTACAGATTTAACCGAAAAC | plastid_5_5 | CCTCTACCCCTACCATACTCAAGCC | colwel_1_5 | GTTAGCTGCGCCACTCACGGATCAA |
| crenarch_1_6 | CAGCCTGTACGTTGAGCGTACAGAT | plastid_5_6 | GCTAGTTCTCGCGAATTTGCGACTC | colwel_1_6 | CGTTAGCTGCGCCACTCACGGATCA |
| crenarch_1_7 | CCTTGTCACGAACCTCAAGTTCGAT | plastid_5_7 | CCTTCGGCATATGGGGATTTAGCT | colwel_1_7 | GTGCGTTAGCTGCGCCACTCACGGA |
| crenarch_1_8 | CTTGTCACGAACCTCAAGTTCGATA | plastid_5_8 | GACTAACGGTGTTGGGTATGACCAG | colwel_1_8 | TGCGTTAGCTGCGCCACTCACGGAT |
| crenarch_1_9 | TTGTCACGAACCTCAAGTTCGATAA | plastid_5_9 | ACTAAACGGTGTTGGGTATGACCAGC | colwel_1_9 | TTAGCTGCGCCACTCACGGATCAAG |
| crenarch_1_10 | CTGTACGTTGAGCGTACAGATTTAA | plastid_5_10 | CCAACAGTTATTCCCCTCCTAAGGG | colwel_1_10 | GCGGTTAGCTGCGCCACTCACGGATC |
| crenarch_1_11 | GTCACGAACCTCAAGTTCGATAACG | plastid_5_11 | CTCTCGGCATATGGGGATTTAGCTG | colwel_1_11 | AGCTGCGCCACTCACGGATCAAGTC |
| crenarch_1_12 | TTCCCTGTCACGAACCTCAAGTTC | plastid_5_12 | GCGCGAGTCATCCTTAGGCAGTGT | colwel_1_12 | GCGGTATTGCTGCCCTCTGTACCTG |
| crenarch_1_13 | TCACGAACCTCAAGTTCGATAACGC | plastid_5_13 | GCGAGTCATCCTTAGGCAGTGTA | colwel_1_13 | CGCGGTATTGCTGCCCTCTGTACCT |
| crenarch_1_14 | TGTCACGAACCTCAAGTTCGATAAC | plastid_5_14 | GCGAGTCATCCTTAGGCAGTGTAA | colwel_1_14 | GGATCAAGTCCACGAACGGCTAGTT |
| crenarch_1_15 | CTGCAGCACTGCATTGGCCACAAGC | plastid_5_15 | CACCTCTCGGCATATGGGGATTTAG | colwel_1_15 | CGGATCAAGTCCACGAACGGCTAGT |
| crenarch_1_16 | GCAGCCTGTACGTTGAGCGTACAGA | plastid_5_16 | ACCTCTCGGCATATGGGGATTTAGC | colwel_1_16 | GCGCCACTCACGGATCAAGTCCACG |
| crenarch_1_17 | CACGAACCTCAAGTTCGATAACGCC | plastid_5_17 | GCAGCCTACAATCCGAACTTGGACA | colwel_1_17 | ACGGATCAAGTCCACGAACGGCTAG |
| crenarch_1_18 | TGTACGTTGAGCGTACAGATTTAAC | plastid_5_18 | GGGCGGAGTCATCCTTAGGCAGTG | colwel_1_18 | CACGGATCAAGTCCACGAACGGCTA |
| crenarch_1_19 | CGTTGAGCGTACAGATTTAACCGAA | plastid_5_19 | CGGACAGTTCTCTCTAGAGATCCAAT | colwel_1_19 | CGCCACTCACGGATCAAGTCCACGA |
| crenarch_1_20 | GTACGTTGAGCGTACAGATTTAACC | plastid_5_20 | ATCACCGGCAGTCTCTCTAGAGATC | colwel_1_20 | GCCACTCACGGATCAAGTCCACGAA |
| crenarch_1_21 | CCTGCAGCACTGCATTGGCCACAAG | plastid_5_21 | CACCGGGCAGTCTCTCTAGAGATCCC | colwel_1_21 | TCAACGGATCAAGTCCACGAACGGCT |
| crenarch_1_22 | GGCAGCCTGTACGTTGAGCGTACAG | plastid_5_22 | ACCGGGCAGTCTCTCTAGAGATCCA | colwel_1_22 | GATCAAGTCCACGAACGGCTAGTTG |
| crenarch_1_23 | TACGTTGAGCGTACAGATTTAACCG | plastid_5_23 | CCGGCAGTCTCTCTAGAGATCCCAA | colwel_1_23 | ACTCACGGATCAAGTCCACGAACGG |
| crenarch_1_24 | ACGTTGAGCGTACAGATTTAACCGA | plastid_5_24 | TTCGCCCTCTCAGTGTCAGTAATGGC | colwel_1_24 | CACTCACGGATCAAGTCCACGAACG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| crenarch_1_25 | CCACTCCCTAGCTCTGCAGTATTCC | plastid_5_25 | TCGCCTTCTCAGTGTCAGTAATGCC | colwel_1_25 | CTCACGGATCAAGTCCACGAACGGC |
| acido_1_1 | TGCAGCACCTCTTCTGGAGTCCCCG | margrpA_1_1 | GCTCCGGTACCGAAGGGGTCGAATC | altero_3_1 | CAACTGTTGTCCCCACGTTTTGGC |
| acido_1_2 | GCCGGCAGTCCCCAAAGTCCCCG | margrpA_1_2 | AGCTCCGGTACCGAAGGGGTCGAAT | altero_3_2 | AACTGTTGTCCCCACGTTTTGGCA |
| acido_1_3 | CCATGCAGCACCTCTTCTGGAGTCC | margrpA_1_3 | CACCCGGATTCGGGTACTACTGACTT | altero_3_3 | CCCCACGTTTTGGCATATTCCCAAG |
| acido_1_4 | CATGCAGCACCTCTTCTGGAGTCCC | margrpA_1_4 | ACCCGGATTCGGGTACTACTGACTTC | altero_3_4 | CCCACGTTTTGGCATATTCCCAAGC |
| acido_1_5 | GCGCCGGCAGTCCCCCAAAGTCCC | margrpA_1_5 | CTCCGGTACCGAAGGGGTCGAATCC | altero_3_5 | TCCCCACGTTTTGGCATATTCCCA |
| acido_1_6 | ATGCAGCACCTCTTCTGGAGTCCCC | margrpA_1_6 | CCACCCGATTCGGGTACTACTGACT | altero_3_6 | CCCCACGTTTTGGCATATTCCCAA |
| acido_1_7 | CGCCGGCAGTCCCCCAAAGTCCCC | margrpA_1_7 | GCCACCCGATTCGGGTACTACTGA | altero_3_7 | CCAACTGTTGTCCCCACGTTTTGG |
| acido_1_8 | GCAGCACCTCTTCTGGAGTCCCCGA | margrpA_1_8 | GGCCACCCGATTCGGGTACTACTGA | altero_3_8 | GTCCCCACGTTTTGGCATATTCCC |
| acido_1_9 | CAGCACCTCTTCrGGAGTCCCCGAA | margrpA_1_9 | TAGCTCCGGTACCGAAGGGGTCGAA | altero_3_9 | ACTGTTGTCCCCACGTTTTGGCAT |
| acido_1_10 | AGCACCTCTTCTGGAGTCCCCGAAG | margrpA_1_10 | TCCGGTACCGAAGGGGTCGAATCCC | altero_3_10 | TCCAACTGTTGTCCCCACGTTTTG |
| acido_1_11 | CCGGCAGTCCCCCAAAGTCCCCGG | margrpA_1_11 | GAAGGGGTCGAATCCCCGACACCA | altero_3_11 | TGTCCCCACGTTTTGGCATATTC |
| acido_1_12 | GCAGTCCCCCAAAGTCCCCGGCAT | margrpA_1_12 | AAGGGGTCGAATCCCCGACACCAA | altero_312 | GCATACCATGCTGTTAGCAACCC |
| acido_1_13 | GCACCTCTTCTGGAGTCCCCGAAGG | margrpA_1_13 | CTTCCCTTACGACAGACCTTTACGC | altero_313 | CGCATACCATGCTGTTAGCAACC |
| acido_1_14 | GCCATGCAGCACCTCTTCTGGAGTC | margrpA_1_14 | CCCGATTCGGGTACTACTGACTTCC | altero_314 | TCGCATACCATGCTGTTAGCAAC |
| acido_1_15 | ACCTCTTCTGGAGTCCCCGAAGGGA | margrpA_1_15 | ACAACTGTATCCCGAAGGATCCGCT | altero_315 | CTGTTGTCCCCACGTTTTGGCATA |
| acido_1_16 | CACCTCTTCTGGAGTCCCCGAAGGG | margrpA_1_16 | CAACTGTATCCCGAAGGATCCGCTG | altero_316 | CTTGGGCTAATCAAAACGCGCAAGG |
| acido_1_17 | CGGCAGTCCCCCAAAGTCCCCGGC | margrpA_1_17 | AACTGTATCCCGAAGGATCCGCTGC | altero_317 | TCCCACTTGGGCTAATCAAAACGCG |
| acido_1_18 | CCCGAAGGGGCCTTACCGCTCAAC | margrpA_1_18 | AACAACTGTATCCCGAAGGATCCG | altero_3_18 | TTGGGCTAATCAAAACGCGCAAGGC |
| acido_1_19 | CCTCTTCTGGAGTCCCCGAAGGGAA | margrpA_1_19 | GTTAGCTCCGGTACCGAAGGGGTCG | altero_3_19 | CCCACTTGGGCTAATCAAAACGCGC |
| acido_1_20 | GGCAGTCCCCCAAAGTCCCCGGCA | margrpA_1_20 | TTAGCTCCGGTACCGAAGGGGTCGA | altero_3_20 | TCACCGGCAGTCTCCCTATAGTTCC |
| acido_1_21 | AGCCATGCAGCACCTCTTCTGGAGT | margrpA_1_21 | GCGTTAGCTCCGGTACCGAAGGGGT | altero_3_21 | TGGGCTAATCAAAACGCGCAAGGCC |
| acido_1_22 | CAGCCATGCAGCACCTCTTCTGGAG | margrpA_1_22 | CGTTAGCTCCGGTACCGAAGGGGTC | altero_3_22 | CCACTTGGGCTAATCAAAACGCGCA |
| acido_1_23 | CCCCCGAAGGGGCCTCACCGCTCAA | margrpA_1_23 | TGCGTTAGCTCCGGTACCGAAGGGG | altero_3_23 | ATAGTTCCCGACATAACTCGCTGGC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE SEQUENCE |
|---|---|---|---|---|---|
| acido_1_24 | ACAGCCATGCAGCACCCTTCTGGA | margrpA_1_24 | TCCCTTACGACAGACCTTTACGCTC | altero_3_24 | CCATCGCTGGTTAGCAACCCTTTGT |
| acido_1_25 | CCGAAGGGGCCTTACCGCTCAACTT | margrpA_1_25 | ACTGTATCCGAAGGATCCGCTGCA | altero_3_25 | GGGCTAATCAAAACGCGCAAGGCCC |
| acido_2_1 | GTCAACTCCCTCCACACCAAGTGTT | margrpA_2_1 | GCTGCCTTCGCATTTGACTTTCCTC | gamma_1_1 | CTAAAAGGTCAAGCCTCCCAACGG |
| acido_2_2 | GGTCAACTCCCTCCACACCAAGTGT | margrpA_2_2 | GGCTGCCTTCGCATTTGACTTTCCT | gamma_1_2 | ACTAAAAGGTCAAGCCTCCCAACGG |
| acido_2_3 | GGGTCAACTCCCTCCACACCAAGTG | margrpA_2_3 | AGGCTGCCTTCGCATTTGACTTTCC | gamma_1_3 | GAAGAGGCCCTCTTTCCCTCTTAAG |
| acido_2_4 | TCAACTCCCTCCACACCAAGTGTTC | margrpA_2_4 | ACAACTGTGCTCCGAAGAGCCCCT | gamma_1_4 | CACTAAAAGGTCAAGCCTCCCAACG |
| acido_2_5 | GGGGTCACCTCCCTCCACACCAAGT | margrpA_2_5 | TAACAACTGTGCTCCGAAGAGCCCG | gamma_1_5 | GCATGTATTAGGCCTGCCGCCAACG |
| acido_2_6 | AGGGGTCAACTCCCTCCACACCAAG | margrpA_2_6 | AACAACTGTGCTCCGAAGAGCCCGC | gamma_1_6 | GGCTCCTCCAATAGTGAGAGCTTTC |
| acido_2_7 | CAACTCCCTCCACACCAAGTGTTCA | margrpA_2_7 | GATACCATCTTCGGGTACTGCAGAC | gamma_1_7 | AAGAGGCCCTCTTTCCCTCTTTCCCTCTT |
| acido_2_8 | AAGGGGTCAACTCCCTCCACACCAA | margrpA_2_8 | TTAACAACTGTGCTCCGAAGAGCCC | gamma_1_8 | CAAGAAGAGGCCCCTCTTTCCCTCTT |
| acido_2_9 | GAAGGGGTCAACTCCCTCCACACCA | margrpA_2_9 | CAACTGTGCTCCGAAGAGCCCGCTG | gamma_1_9 | TCAAGAAGAGGCCCTCTTTCCCTCT |
| acido_2_10 | AACTCCCTCCACACCAAGTGTTCAT | margrpA_2_10 | CAGAAGGCTGCCTTCGCATTTGACT | gamma_1_10 | TAGCTGCGCCACTAAAAGGTCAAGC |
| acido_2_11 | ACTCCCTCCACACCAAGTGTTCATC | margrpA_2_11 | ACCATCTTCGGGTACTGCAGATTTC | gamma_1_11 | CAGGCTCCTCCAATAGTGAGAGCTT |
| acido_2_12 | CTCCCTCCACACCAAGTGTTCATCG | margrpA_2_12 | TTGCGGTTAGGATACCATCTTCGGG | gamma_1_12 | CTCAGGCTCAGTATCAATCCAGGGG |
| acido_2_13 | CAGTCCCCGTAGAGTTCCGCCATG | margrpA_2_13 | CTTGCGGTTAGGATACCATCTTCGG | gamma_1_13 | AAAGGTCAAGCCTCCCAACGCTAG |
| acido_2_14 | TCCCCGTAGAGTTCCCGCCATGACG | margrpA_2_14 | CCTTGCGGTTAGGATACCATCTTCG | gamma_1_14 | AGAGGCCCTCTTTCCCTCTTAAGGC |
| acido_2_15 | GTCCCCGTAGAGTTCCCGCCATGAC | margrpA_2_15 | CCATCTTCGGGTACTGCAGACTTCC | gamma_1_15 | GAGGCCCTCTTTCCCTCTTAAGGCG |
| acido_2_16 | AGTCCCCGTAGAGTTCCCGCCATGA | margrpA_2_16 | GGATACCATCTTCGGGTACTGCAGA | gamma_1_16 | AGAGGCCCTCTTTCCCTCTTAAGGC |
| acido_2_17 | GCAGTCCCCGTAGAGTTCCCGCCAT | margrpA_2_17 | ACCTGCCTTACCTTAAACAGCTCCC | gamma_1_17 | CCCCCTCTATCGTACTCTAGCCTAT |
| acido_2_18 | GGCAGTCCCCGTAGAGTTCCCGCCA | margrpA_2_18 | CCTGCCTTACCTTAAACAGCTCCCT | gamma_1_18 | CCCCTCTATCGTACTCTAGCCTATC |
| acido_2_19 | CCGGCACGGAAGGGGTCAACTCCCT | margrpA_2_19 | CCAGAAGGCTGCCTTCGCATTTGAC | gamma_1_19 | TTCAAGAAGAGGCCCCTCTTTCCCTC |
| acido_2_20 | ACGCGCTGGCAACTACGGGGTAAGG | margrpA_2_20 | TGCGGTTAGGATACCATCTTCGGGT | gamma_1_20 | AGGCCCTCTTTCCCTCTTAAGGCGT |
| acido_2_21 | GACGCGCTGGCAACTACGGGTAAG | margrpA_2_21 | CGAAGAGCCCGCTGCATTATTTGT | gamma_1_21 | GCCCTCTTTCCCTCTTAAGGCGTAT |
| acido_2_22 | TGACGCGCTGGCAACTACGGGTAAG | margrpA_2_22 | CCACCATGAATTCGCGTTCCTCTC | gamma_1_22 | CCCTCTTTCCCTCTTAAGGCGTATG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE SEQUENCE |
|---|---|---|---|---|---|
| acido_2_23 | AGCTCCGGCACGGAAGGGGTCAACT | margrpA_2_23 | CCTCCTTGCGGTTAGGATACCATCT | gamma_1_23 | CTCTTTCCCTCTTAAGGCGTATGCG |
| acido_2_24 | GCTCCGGCACGGAAGGGGTCAACTC | margrpA_2_24 | CATCTTCGGGTACTGCAGACTTCCA | gamma_1_24 | CCTCTTTCCCTCTTAAGGCGTATGC |
| acido_2_25 | CTCCGGCACGGAAGGGGTCAACTCC | margrpA_2_25 | CGGTTAGGATACCATCTTCGGGTAC | gamma_1_25 | GGCCCTCTTTCCCTCTTAAGGCGTA |
| acido_3_1 | CTCACGGCATTCGTCCCACTCGACA | OP10_1_1 | CCGCTTGCACGGGCAGTTCCGTAAG | gamma_2_1 | TACCTGCTAGCAACCAGGGATAGGG |
| acido_3_2 | CGAGGTCCCCACGGTGTCATGCGGT | OP10_1_2 | CCCGCTTGCACGGGCAGTTCCGTAA | gamma_2_2 | CAGCATTACCTGCTAGCAACCAGGG |
| acido_3_3 | TCACCCTCACGGCATTCGTCCCACT | OP10_1_3 | CGCTTGCACGGGCAGTTCCGTAAGA | gamma_2_3 | TTACCTGCTAGCAACCAGGGATAGG |
| acido_3_4 | AGGTCCCCACGGTGTCATGCGGTAT | OP10_1_4 | TCCCGCTTGCACGGGCAGTTCCGTA | gamma_2_4 | ACCTGCTAGCAACCAGGGATAGGG |
| acido_3_5 | GGACCGAGGTCCCCACGGTGTCATG | OP10_1_5 | GGGTGCAGACAATTCAGGTGACTTG | gamma_2_5 | TCAGCATTACCTGCTAGCAACCAGG |
| acido_3_6 | CCGAGGTCCCCACGGTGTCATGCGG | OP10_1_6 | CTCCCGCTTGCACGGGCAGTTCCGT | gamma_2_6 | TCTCCCTGGAGTTCTCAGCATTACC |
| acido_3_7 | ACCCTCACGGCATTCGTCCCACTCG | OP10_1_7 | CCTCCCGCTTGCACGGGCAGTTCCG | gamma_2_7 | GTCTCCCTGGAGTTCTCAGCATTAC |
| acido_3_8 | ACCGAGGTCCCCACGGTGTCATGCG | OP10_1_8 | GCTTGCACGGGCAGTTCCGTAAGAG | gamma_2_8 | CAGTCTCCCTGGAGTTCTCAGCATT |
| acido_3_9 | CACCCTCACGGCATTCGTCCCACTC | OP10_1_9 | CGGGTGCAGACAATTCAGGTGACTT | gamma_2_9 | TCCCTGGAGTTCTCAGCATTACCTG |
| acido_3_10 | GACCGAGGTCCCCACGGTGTCATGC | OP10_1_10 | CCGTAAGAGTTCCCGACTTTACGCT | gamma_2_10 | CTCCCTGGAGTTCTCAGCATTACCT |
| acido_3_11 | CCTCACGGCATTCGTCCCACTCGAC | OP10_1_11 | GCAGACAATTCAGGTGACTTGACGG | gamma_2_11 | GCAGTCTCCCTGGAGTTCTCAGCAT |
| acido_3_12 | TTCACCCTCACGGCATTCGTCCCAC | OP10_1_12 | TCGGGTGCAGACAATTCAGGTGACT | gamma_2_12 | GGCAGTCTCCCTGGAGTTCTCAGCA |
| acido_3_13 | GAGGTCCCCACGGTGTCATGCGGTA | OP10_1_13 | CGTAAGAGTTCCCGACTTTACGCTG | gamma_2_13 | CCTGCTAGCAACCAGGGATAGGGGT |
| acido_3_14 | CCCTCACGGCATTCGTCCCACTCGA | OP10_1_14 | TTGCACGGGCAGTTCCGTAAGAGTT | gamma_2_14 | TGCTAGCAACCAGGGATAGGGGTTG |
| acido_3_15 | GGTCCCCACGGTGTCATGCGGTATT | OP10_1_15 | TCCGTAAGAGTTCCCGACTTTACGC | gamma_2_15 | CTGCTAGCAACCAGGGATAGGGGTT |
| acido_3_16 | GTCCCCACGGTGTCATGCGGTATTA | OP10_1_16 | GGCAGTTCCGTAAGAGTTCCCGACT | gamma_2_16 | TAGCAACCAGGGATAGGGGTTGCGC |
| acido_3_17 | GATTGTTCACCCTCACGGCATTCGT | OP10_1_17 | CTTGCACGGGCAGTTCCGTAAGACT | gamma_2_17 | AGCAACCAGGGATAGGGGTTGCGCT |
| acido_3_18 | AGGACCGAGGTCCCCACGGTGTCAT | OP10_1_18 | CGGGCAGTTCCGTAAGAGTTCCCGA | gamma_2_18 | CTCAGCATTACCTGCTAGCAACCAG |
| acido_3_19 | ATTGTTCACCCTCACGGCATTCGTC | OP10_1_19 | TGCACGGGCAGTTCCGTAAGAGTTC | gamma_2_19 | CTAGCAACCAGGGATAGGGGTTGCG |
| acido_3_20 | TTGTTCACCCTCACGGCATTCGTCC | OP10_1_20 | ACGGGCAGTTCCGTAAGAGTTCCCG | gamma_2_20 | GCTAGCAACCAGGGATAGGGGTTGC |
| acido_3_21 | TGTTCACCCTCACGGCATTCGTCCC | OP10_1_21 | GCACGGGCAGTTCCGTAAGAGTTCC | gamma_2_21 | GCATTACCTGCTAGCAACCAGGGAT |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| acido_3_22 | GGATTGTTCACCCTCACGGCATTCG | OP10_1_22 | CACGGGGCAGTTCCGTAAGAGTTCCC | gamma_2_22 | AGCATTACCTGCTAGCAACCAGGGA |
| acido_3_23 | CACGGCATTCGTCCCACTCGACAGG | OP10_1_23 | GCAGTTCCGTAAGAGTTCCCGACTT | gamma_2_23 | TCGCGAGTTGGCAGCCCTCTGTACG |
| acido_3_24 | TCACGGCATTCGTCCCACTCGACAG | OP10_1_24 | GGGCAGTTCCGTAAGAGTTCCCGAC | gamma_2_24 | CTCGCGAGTTGGCAGCCCTCTGTAC |
| acido_3_25 | GCTTTGATCCAAGGACCGAGGTCC | OP10_1_25 | CCCCCTTACTCCCCACACCTTAGAC | gamma_2_25 | CGCGAGTTGGCAGCCCTCTGTACGC |
| actino_1_1 | AAACCTAGATCCGTCATCCCACACG | OP3_1_1 | ATCCAAGGGTGATAGGTCCTTACGG | gamma_3_1 | TGCGACACCGAAGGGCAACCCCCC |
| actino_1_2 | CAAACCTAGATCCGTCATCCCACAC | OP3_1_2 | TCCAAGGGTGATAGGTCCTTACGGA | gamma_3_2 | CTGCGACACCGAAGGGCAACCCCCC |
| actino_1_3 | CACCACCTGTATAGGGCGCTAATGC | OP3_1_3 | CCAAGGGTGATAGGTCCTTACGGAT | gamma_3_3 | GACTAGTTCCGAGTATGTCAAGGGC |
| actino_1_4 | ACCACCTGTATAGGGCGCTAATGCA | OP3_1_4 | TGTTCTCCCCTGCTGACAGGAGTTT | gamma_3_4 | GCTGCCGACACCGAAGGGCAACCCC |
| actino_1_5 | CCACCTGTATAGGGCGCTAATGCAC | OP3_1_5 | TTGTTCTCCCCTGCTGACAGGAGTT | gamma_3_5 | AACGCGTAGCTGCGACACCGAAGG |
| actino_1_6 | CACCTGTATAGGGCGCTAATGCACA | OP3_1_6 | CTTGTTCTCCCCTGCTGACAGGAGT | gamma_3_6 | TAACGCGTAGCTGCGACACCGAAG |
| actino_1_7 | GCACCACCTGTATAGGGCGCTAATG | OP3_1_7 | GTTCTCCCCTGCTGACAGGAGTTTA | gamma_3_7 | TTACTTAACCGCCAACGCGCTTT |
| actino_1_8 | AACCTAGATCCGTCATCCCACACGC | OP3_1_8 | CATCCAAGGGTGATAGGTCCTTACG | gamma_3_8 | ACGCGTAGCTGCGACACCGAAGGG |
| actino_1_9 | TGCACCACCTGTATAGGGCGCTAAT | OP3_1_9 | TCGACAGGTTATCCCGAACCCTAGG | gamma_3_9 | TTAACGCGTAGCTGCGACACCGAA |
| actino_1_10 | AGCCCTGAACTTTCACGACCGACTT | OP3_1_10 | TTCGACAGGTTATCCCGAACCCTAG | gamma_3_10 | CGCGCTAGCTGCGACACCGAAGGGC |
| actino_1_11 | GCCCTGAACTTTCACGACCGACTTG | OP3_1_11 | TTCTCCCCTGCTGACAGGAGTTTAC | gamma_3_11 | TACTTAACCGCCAACGCGCTTTA |
| actino_1_12 | GAGCCCTGAACTTTCACGACCGACT | OP3_1_12 | CCATCCAAGGGTGATAGTCCTTAC | gamma_3_12 | AGCTGCGACACCGAAGGGCAACCCC |
| actino_1_13 | AGCGTCGATAGCGGCCCAGTGAGCT | OP3_1_13 | TGATAGGTCCTTACGGATCCCCATC | gamma_3_13 | CTTACTTAACCGCCAACGCGCTT |
| actino_1_14 | GCGTCGATAGCGGCCCAGTGAGCTG | OP3_1_14 | TCTCCCCTGCTGACAGGAGTTTACA | gamma_3_14 | ATCCGACTTACTTAACCGCCAACGC |
| actino_1_15 | CGTCGATAGCGGCCCAGTGAGCTGC | OP3_1_15 | CGGATCCCCATCTTTCCCTCATGTT | gamma_3_15 | CGACTTACTTAACCGCCAACGCGCG |
| actino_1_16 | CAGCGTCGATAGCGGCCCAGTGAGC | OP3_1_16 | TCCTTGCCGGTTAGGCAACCTACTT | gamma_3_16 | TCCGACTTACTTAACCGCCAACGCG |
| actino_1_17 | CCCTGAACTTTCACGACCGACTTGT | OP3_1_17 | AGTGCGCACCGACCGAAGTCGGTGT | gamma_3_17 | CTTAACGCGCTAGCTGCGACACCGA |
| actino_1_18 | TGAGCCCTGAACTTTCACGACCGAC | OP3_1_18 | CCAGTAATGCGCCTTCGCGACTGGT | gamma_3_18 | ACTTACTTAACCGCCAACGCGCGCT |
| actino_1_19 | ACCTAGATCCGTCATCCCACACGCG | OP3_1_19 | AGAGTGCGCACCGACCGAAGTCGGT | gamma_3_19 | GCGCTAGCTGCGACACCGAAGGGCA |
| actino_1_20 | CTCGGGCTATCCCAGTAACTAAGGT | OP3_1_20 | TCGAAAAGCACAGGACGACTATCCGGT | gamma_3_20 | CCGACTTACTTAACCGCCAACGCGC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| actino_1_21 | CCTCGGGCTATCCCAGTAACTAAGG | OP3_1_21 | CTGTGCTTCGAAAAGCACAGGACGT | gamma_3_21 | ACTTAACCGCCAACGCGCGCTTTAC |
| actino_1_22 | TCGATAGCGGCCCAGTGAGCTGCCT | OP3_1_22 | CCTTAGAGTGCGACCGACCGAAGT | gamma_3_22 | CATCCGACTTACTTAACCGCCAACG |
| actino_1_23 | GTCGATAGCGGCCCAGTGAGCTGCC | OP3_1_23 | GCCCTCCTTGCCGGTTAGGCAACCT | gamma_3_23 | TCTTCACACGCGGCATTGCTAGA |
| actino_1_24 | CGATAGCGGCCCAGTGAGCTGCCTT | OP3_1_24 | CTCCTTGCCGGTTAGGCAACTACT | gamma_3_24 | AGAACTTAACCGCGCTAGCTGCGACA |
| actino_1_25 | TCCTCGGGCTATCCCAGTAACTAAG | OP3_1_25 | CAGTAATGCGCCTTCGCGACTGGTG | gamma_3_25 | ACTTAACGCGCTAGCTGCGACACCG |
| actino_2_1 | CCGGTTTCCCCAAGTGCAAGCACTT | OP9_1_1 | GGGCAAGATAATGTCAAGTCCCGT | gamma_4_1 | ACACCCGAAAGGCAAACCCTCCCGA |
| actino_2_2 | CAAGCACTTGGTTCGTCCCTCGACT | OP9_1_2 | GCTGGCACATAATTAGCCGGAGCTT | gamma_4_2 | GACACCCGAAAGGCAAACCCTCCGA |
| actino_2_3 | GCCGGTTTCCCCAAGTGCAAGCACT | OP9_1_3 | TGCTGGCACATAATTAGCCGGAGCT | gamma_4_3 | CACCCGAAAGGCAAACCCTCCCGACA |
| actino_2_4 | GCTTCGACACGGAAATCGTGAACTG | OP9_1_4 | CCACTTACCAGGGTAGAGATTACCAC | gamma_4_4 | ACCCGAAAGGCAAACCCTCCCGACAT |
| actino_2_5 | TTCGCCCGGTTTCCCAAGTGCAAGC | OP9_1_5 | CCCCACCATTACAGGGTAGATTACCCA | gamma_4_5 | CGACACCCGAAAGGCAAACCCTCCCG |
| actino_2_6 | CGACACGGAAATCGTGAACTGATCC | OP9_1_6 | CCCCACCATTACAGGGTAGATTACCC | gamma_4_6 | CCGAAAGGCAAACCCTCCCGACATC |
| actino_2_7 | GACACGGAAATCGTGAACTGATCCC | OP9_1_7 | CTGCTAACCTCATCATCCCGAAGGA | gamma_4_7 | GCGACACCCGAAAGGCAAACCCTCCC |
| actino_2_8 | ACACGGAAATCGTGAACTGATCCCC | OP9_1_8 | TCTGCTAACCTCATCATCCCGAAGG | gamma_4_8 | CGAAAGGCAAACCCTCCCGACATCT |
| actino_2_9 | CGCCGGTTTCCCAAGTGCAAGCAC | OP9_1_9 | CTGCTGGCACATAATTAGCCGGAGC | gamma_4_9 | GCTGCGACACCCGAAAGGCAAACCCT |
| actino_2_10 | ACGGAAATCGTGAACTGATCCCCAC | OP9_1_10 | CCACTTACCAGGGTAGATTACCACG | gamma_4_10 | AGCTGCGACACCCGAAAGGCAAACCC |
| actino_2_11 | TCGCCGGTTTCCCAAGTGCAAGCA | OP9_1_11 | GACGGGCAAGATAATGTCAAGTCCC | gamma_4_11 | TTGGCTAGCCATTGCTGGGTTTGCAG |
| actino_2_12 | CACGGAAATCGTGAACTGATCCCCA | OP9_1_12 | TCCCCCACTTACCAGGGTAGATTACC | gamma_4_12 | TGGCTAGCCATTGCTGGTTTGCAGC |
| actino_2_13 | CGGTTTCCCAAGTGCAAGCACTTG | OP9_1_13 | GCAGTCTGCCTAGAGTGCACTTGTA | gamma_4_13 | GGATTGGCTAGCCATTGCTGTGTTTG |
| actino_2_14 | AAGTGCAAGCACTTGGTTCGTCCCT | OP9_1_14 | GCTGCTGGCACATAATTAGCCGGAG | gamma_4_14 | GATTGGCTAGCCATTGCTGGTTTGC |
| actino_2_15 | GTTCGCCGGTTTCCCCAAGTGCAAG | OP9_1_15 | GGGTACCGTCAGGCTTAAGGGTTTA | gamma_4_15 | GGGATTGGCTAGCCATTGCTGTGTTT |
| actino_2_16 | CGGAAATCGTGAACTGATCCCCACA | OP9_1_16 | CACTTACAGGGTAGATTACCACGC | gamma_4_16 | GGCTAGCCATTGCTGGTTTGCAGCC |
| actino_2_17 | GCAAGCACTTGGTTCGTCCCTCGAC | OP9_1_17 | GGCAGTCTGCCTAGAGTGCACTTGT | gamma_4_17 | GAAAGGCAAACCCTCCCGACATCTA |
| actino_2_18 | CGTTCGCCGGTTTCCCCAAGTGCAA | OP9_1_18 | GGTTATCCCCCACTTACCAGGGTAGA | gamma_4_18 | CTGCGACACCCGAAAGGCAAACCCTC |
| actino_2_19 | AAGCACTTGGTTCGTCCCTCGACTT | OP9_1_19 | GAGGGTATCCCCCACTTACAGGGT | gamma_4_19 | TGCCGACACCCGAAAGGCAAACCCTCC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| actino_2_20 | GGTTTCCCCAAGTGCAAGCACTTGG | OP9_1_20 | GGGTTATCCCCACTTACAGGGTAG | gamma_4_20 | AGGGATTGGCTAGCCATTGCTGGTT |
| actino_2_21 | AGTGCAAGCACTTGGTTCGTCCCTC | OP9_1_21 | GTCAGAGATAGACCAGAAAGCCGCC | gamma_4_21 | AAGGGATTGGCTAGCCATTGCTGGT |
| actino_2_22 | CAAGTGCAAGCACTTGGTTCGTCCC | OP9_1_22 | GGGGTACCGTCAGGCTTAAGGGTTT | gamma_4_22 | TAAGGGATTGGCTAGCCATTGCTGG |
| actino_2_23 | CCGTTCGCCCGGTTTCCCCAAGTGCA | OP9_1_23 | AGGGTTATCCCCACTTACAGGGTA | gamma_4_23 | TAGCTGCGACACCGAAAGGCAAACC |
| actino_2_24 | CCGTAGTTATCCCGGTGTACAGGGC | OP9_1_24 | CGGCAGTCTGCCTAGAGTGCACTTG | gamma_4_24 | TTAGCTGCGACACCGAAAGGCAAAC |
| actino_2_25 | CCTCAAGCCTTGCAGTATCCGACTGC | OP9_1_25 | CTCCGATTATCTGCGGCAGTCTGC | gamma_4_25 | GTTAGCTGCGACACCGAAAGGCAAA |
| bacter_1_1 | GTTTCCGCGACTGTCATTCCACGTT | plancto_1_1 | TGCAACACCTGTGCAGGTCACACCC | gamma_5_1 | CCACTAAGGGACAAATTCCCCCAAC |
| bacter_1_2 | TTCCCGCGACTGTCATTCCACGTTCG | plancto_1_2 | GCAACACCTGTGCAGGTCACACCCG | gamma_5_2 | CGCCACTAAGGGACAAATTCCCCCA |
| bacter_1_3 | ACGTTTCCGCGACTGTCATTCCACG | plancto_1_3 | ATGCAACACCTGTGCAGGTCACACC | gamma_5_3 | GCCACTAAGGGACAAATTCCCCCAA |
| bacter_1_4 | TTTCCGCGACTGTCATTCCACGTTC | plancto_1_4 | AACACCTGTGCAGGTCACACCCGAA | gamma_5_4 | CACTAAGGGACAAATTCCCCCAACG |
| bacter_1_5 | CACGTTTCCGCGACTGTCATTCCAC | plancto_1_5 | CAACACCTGTGCAGGTCACACCCGA | gamma_5_5 | ACTAAGGGACAAATTCCCCCAACGG |
| bacter_1_6 | TCACGTTTCCGCGACTGTCATTCCA | plancto_1_6 | TGTGCAGGTCACACCCGAAGGTAAT | gamma_5_6 | CTAAGGGACAAATTCCCCCAACGGC |
| bacter_1_7 | CGTTTCCGCGACTGTCATTCCACGT | plancto_1_7 | GTGCAGGTCACACCCGAAGGTAATC | gamma_5_7 | GCGCCACTAAGGGACAAATTCCCCC |
| bacter_1_8 | TGTCATTCCACGTTCGAGCCCAGGT | plancto_1_8 | TGCAGGTCACACCCGAAGGTAATCA | gamma_5_8 | GGTACCGTCAAGACGGCATGGATT |
| bacter_1_9 | CTGTCATTCCACGTTCGAGCCCAGG | plancto_1_9 | CTGTGCAGGTCACACCCGAAGGTAA | gamma_5_9 | AGGTACCGTCAAGACGCGCAGTTAT |
| bacter_1_10 | CCGCGACTGTCATTCCACGTTCGAG | plancto_1_10 | CCTGTGCAGGTCACACCCGAAGTA | gamma_5_10 | TAGGTACCGTCAAGACGCGCAGTTA |
| bacter_1_11 | ACTGTCATTCCACGTTCGAGCCCAG | plancto_1_11 | ACACCTGTGCAGGTCACACCCGAAG | gamma_5_11 | TGCGCCACTAAGGGACAAATTCCCC |
| bacter_1_12 | CGCGACTGTCATTCCACGTTCGAGC | plancto_1_12 | ACAGAGTTAGCCAGTGCTTCCTCTC | gamma_5_12 | TAAGGGACAAATTCCCCCAACGGCT |
| bacter_1_13 | GCGACTGTCATTCCACGTTCGAGCC | plancto_1_13 | ACCTGTGCAGGTCACACCCGAAGGT | gamma_5_13 | CTGTAGGTACCGTCAAGACGGCGCAG |
| bacter_1_14 | CGACTGTCATTCCACGTTCGAGCCC | plancto_1_14 | CATGCAACACCTGTGCAGGTCACAC | gamma_5_14 | GTAGGTACCGTCAAGACGCGCAGTT |
| bacter_1_15 | TCCGCGACTGTCATTCCACGTTCGA | plancto_1_15 | CACCTGTGCAGGTCACACCCGAAGG | gamma_5_15 | CTGCGCCACTAAGGGACAAATTCCC |
| bacter_1_16 | GACTGTCATTCCACGTTCGAGCCCA | plancto_1_16 | CACAGAGTTAGCCAGTGCTTCCTCT | gamma_5_16 | TGTAGGTACCGTCAAGACGCGCAGT |
| bacter_1_17 | ATCACGTTTCCGCGACTGTCATTCC | plancto_1_17 | CAGAGTTAGCCAGTGCTTCCTCTCG | gamma_5_17 | TCTGTAGGTACCGTCAAGACGCGCA |
| bacter_1_18 | GTCATTCCACGTTCGAGCCCAGGTA | plancto_1_18 | AGCCAGTGCTTCCTCTCGAGCTTAC | gamma_5_18 | GTCCGCCACTCGACGCCTGAAGAGC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| bacter_1_19 | ACGGTACCATCAGCACCGATACACG | plancto_1_19 | GCACAGAGTTAGCCAGTGCTTCCTC | gamma_5_19 | GCCACTCGACGCCTGAAGAGCAAGC |
| bacter_1_20 | GTACCATCAGCACCGATACACGACC | plancto_1_20 | GGCCTAGCCCCTGCATGTCAAGCCT | gamma_5_20 | GCTGCGCCACTAAGGGACAAATTCC |
| bacter_1_21 | GGTACCATCAGCACCGATACACGAC | plancto_1_21 | GCAGGTCACACCCGAAGGTAATCAG | gamma_5_21 | CACTCGGTTCCCGAAGGCACCAAAC |
| bacter_1_22 | CGGTACCATCAGCACCGATACACGA | plancto_1_22 | ACCGGCTAGCCCCTGCATGTCAAG | gamma_5_22 | CTTCTGTAGTACCGTCAAGACGCG |
| bacter_1_23 | GATCACGTTTCCGCGACTGTCATTC | plancto_1_23 | CAGGTCACACCCGAAGGTAATCAGC | gamma_5_23 | CACTCGACGCCTGAAGAGCAAGCTC |
| bacter_1_24 | TACGGTACCATCAGCACCGATACAC | plancto_1_24 | CCGGCCTAGCCCCTGCATGTCAAGC | gamma_5_24 | CGCCACTCGACGCCTGAAGAGCAAG |
| bacter_1_25 | CACCGATACACGACCGGTGTTTTT | plancto_1_25 | CGGCCTAGCCCCTGCATGTCAAGCC | gamma_5_25 | GGACAAATTCCCCACGCGGCTAGTT |
| bacter_2_1 | GGATTTCTCCGGGCTACCTTCCGGT | plancto_2_1 | TCTCCGAAGAGCACTCTCCCCTTTC | gamma_6_1 | AGCTGCGCCACCAACCTCTTGAATG |
| bacter_2_2 | CTCCGGGCTACCTTCCGGTAAAGGG | plancto_2_2 | TACGACCGAGAAACTGTGGGAGGTC | gamma_6_2 | CCAACCTCTTGAATGAGGCCGACGG |
| bacter_2_3 | CGGGATTTCTCCGGGCTACCTTCCGG | plancto_2_3 | ACCGGAGAAACTGTGGGAGGTCCCT | gamma_6_3 | TGCGCCACCAACCTCTTGAATGAGG |
| bacter_2_4 | TCTCCGGGCTACCTTCCGGTAAAGG | plancto_2_4 | CGACCGAGAAACTGTGGGAGGTCCC | gamma_6_4 | GCCACCAACCTCTTGAATGAGGCCG |
| bacter_2_5 | TTCTCCGGGCTACCTTCCGGTAAAG | plancto_2_5 | CTCCGAAGAGCACTCTCTCCCTTTCA | gamma_6_5 | ACCAACCTCTTGAATGAGGCCGACG |
| bacter_2_6 | TTTTCTCCGGGCTACCTTCCGGTAA | plancto_2_6 | GCCCCGACCTTCCTCTGAGGTTTGGT | gamma_6_6 | CTGCCCACCAACCTCTTGAATGAG |
| bacter_2_7 | GATTTCTCCGGGCTACCTTCCGGTA | plancto_2_7 | AAACTGTGGGAGGTCCCTCGATCCA | gamma_6_7 | CAACCTCTTGAATGAGGCCGACGGC |
| bacter_2_8 | ATTTCTCCGGGCTACCTTCCGGTAA | plancto_2_8 | TCCGAAGAGCACTCTCCCCTTTCAG | gamma_6_8 | GCGCCACCAACCTCTTGAATGAGGC |
| bacter_2_9 | CCGGATTTCTCCGGGCTACCTTCCG | plancto_2_9 | GACCGAGAAACTGTGGGAGGTCCCT | gamma_6_9 | CGCCACCAACCTCTTGAATGAGGCC |
| bacter_2_10 | TCCGGATTTCTCCGGGCTACCTTCC | plancto_2_10 | ACGACCGAGAAACTGTGGGAGGTCC | gamma_6_10 | CACCAACCTCTTGAATGAGGCCGAC |
| bacter_2_11 | TCCGGGCTACCTTCCGGTAAAGGGT | plancto_2_11 | GAAACTGTGGGAGGTCCCTCGATCC | gamma_6_11 | GCTGCGCCACCAACCTCTTGAATGA |
| bacter_2_12 | ATCCGGATTTCTCCGGGCTACCTTC | plancto_2_12 | CTCTCCGAAGAGCACTCTCCCCTTT | gamma_6_12 | CCAACCTCTTGAATGAGGCCGA |
| bacter_2_13 | CTTTATGGATTAGTCCCCGTCGCT | plancto_2_13 | GCCTGGAGGTAGGTATCACCTGTT | gamma_6_13 | TAGCTGCGCCACCAACCTCTTGAAT |
| bacter_2_14 | ACTTTATGGATTAGTCCCCGTCGC | plancto_2_14 | TCCCGACGCTATTCCCAGCCTGGAG | gamma_6_14 | AACCTCTTGAATGAGGCCGACGGCT |
| bacter_2_15 | CCGGGCTACCTTCCGGTAAAGGGTA | plancto_2_15 | TTGGGCATTACCGCCAGTTTCCCGA | gamma_6_15 | AGAGGTCCACTTTGCCCCGAAGGGC |
| bacter_2_16 | AATCCGGATTTCTCCGGGCTACCTT | plancto_2_16 | CCGAGAAACTGTGGGAGGTCCCTCG | gamma_6_16 | GAGGTCCACTTTGCCCCGAAGGGCG |
| bacter_2_17 | GCTACCTTCCGGTAAAGGGTAGGTT | plancto_2_17 | TGAGCAGACCCATCTCCAGGCCGCC | gamma_6_17 | TCTTCAGGTAACGTCAATACGCGCG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| bacter_2_18 | GGCTACCTTCCGGTAAAGGGTAGGT | plancto_2_18 | AACTGTGGGAGTCCCTCGATCCAG | gamma_6_18 | TTAGCTGCGCCACCAACCTCTTGAA |
| bacter_2_19 | GGGCTACCTTCCGGTAAAGGGTAGG | plancto_2_19 | CCCGACCTTCCTCTGAGGTTTGGTC | gamma_6_19 | CAGAGGTCCACTTTGCCCCGAAGGG |
| bacter_2_20 | TAATCGGATTTCTCCGGGCTACCT | plancto_2_20 | TGGGCATTACCGCCAGTTTCCCGAC | gamma_6_20 | AGGTCCACTTTGCCCCGAAGGGCGT |
| bacter_2_21 | CTACCTTCCGGTAAAGGGTAGGTTG | plancto_2_21 | CGAGAAACTGTGGGAGTCCCTCGA | gamma_6_21 | ACCTCTTGAATGAGGCCGACGGCTA |
| bacter_2_22 | CGGGCTACCTTCCGGTAAAGGGTAG | plancto_2_22 | GAGAAACTGTGGGAGGTCCCTGAT | gamma_6_22 | CGCGCGGGTATTAACCGCACGCTTT |
| bacter_2_23 | TTAATCCGGATTTCTCCGGGCTACC | plancto_2_23 | CAGCCTGAGGTAGGTATCTACCTG | gamma_6_23 | CTTCAGTAACGTCAATACGCGCGG |
| bacter_2_24 | TTTATGGATTAGCTCCCCGTCGCTG | plancto_2_24 | AGCCCGACCTTCCTCTGAGGTTTGG | gamma_6_24 | TCAGAGGTCCACTTTGCCCCGAAGG |
| bacter_2_25 | TACCTTCCGGTAAAGGGTAGGTTGC | plancto_2_25 | AATAGTGAGCAGACCCATCTCCAGG | gamma_6_25 | ACGCGCGGGTATTAACCGCACGCTT |
| bacter_3_1 | GGCTCCTCGCCGTATCATCGAAATT | plancto_3_1 | CGCAGTGCCTCAGTTAAGCTCAGGC | gamma_7_1 | GTCCTCCGTAGTTAGACTAGCCACT |
| bacter_3_2 | CAACCTTGCCAATCACTCCCCAGGT | plancto_3_2 | GCAGTGCCTCAGTTAAGCTCAGGCA | gamma_7_2 | CGTCCTCCGTAGTTAGACTAGCCAC |
| bacter_3_3 | CTTGCCAATCACTCCCCAGGTGGAT | plancto_3_3 | CAACTCTGAGGGAGTACCCTTCAGAG | gamma_7_3 | ACCGTCCTCCGTAGTTAGACTAGCC |
| bacter_3_4 | CAGGTAAGGCTCCTCGCCGTATCAT | plancto_3_4 | GTCAACTCTGAGGGAGTACCCTCAG | gamma_7_4 | CCGTCCTCCGTAGTTAGACTAGCCA |
| bacter_3_5 | AGGCTCCTCGCCGTATCATCGAAAT | plancto_3_5 | TATGTTTTTCCTACGCCGTTCGCGC | gamma_7_5 | GACCGTCCTCCGTAGTTAGACTAGC |
| bacter_3_6 | AACCTTGCCAATCACTCCCCAGGTG | plancto_3_6 | GCAGAAGGAGAACCTCCTCCCGC | gamma_7_6 | TGACCGTCCTCCGTAGTTAGACTAG |
| bacter_3_7 | ACCTTGCCAATCACTCCCCAGGTGG | plancto_3_7 | AACTCTGAGGGAGTACCCTCAGAGA | gamma_7_7 | CTGCAGGTAACGTCAAGTACTCACC |
| bacter_3_8 | TCAACCTTGCCAATCACTCCCCAGG | plancto_3_8 | TCAACTCTGAGGGAGTACCCTCAGA | gamma_7_8 | TATTAGGGGTAAGCCTTCCTCCCTG |
| bacter_3_9 | GGTAAGGCTCCTCGCCGTATCATCG | plancto_3_9 | CTATGTTTTTCCTACGCCGTTGGCCG | gamma_7_9 | TGCAGTAACGTCAAGTACTCACCC |
| bacter_3_10 | TCCGCTACCCCAACTATACTCTAG | plancto_3_10 | TCCTATGTTTTTCCTACGCCGTTCGC | gamma_7_10 | GCAGGTAACGTCAAGTACTCACCCG |
| bacter_3_11 | TTCAACCTTGCCAATCACTCCCCAG | plancto_3_11 | CCTATGTTTTTCCTACGCCGTTCGCC | gamma_7_11 | TTCCCCGGGTTGTCCCCACTCATG |
| bacter_3_12 | CCCAGGTAAGGCTCCTCTCGCCGTATC | plancto_3_12 | ACTCTGAGGGAGTACCCTCAGAGAT | gamma_7_12 | TCCCCGGGTTGTCCCCACTCATGG |
| bacter_3_13 | AGGTAAGGCTCCTCGCCGTATCATC | plancto_3_13 | ACGCAGTGCCTCAGTTAAGCTCAGG | gamma_7_13 | CCCCGGGTTGTCCCCACTCATGGG |
| bacter_3_14 | CCAATCACTCCCCAGGTGGATTACC | plancto_3_14 | TGTCAACTCTGAGGGAGTACCCTCA | gamma_7_14 | TTTCCCCGGGTTGTCCCCACTCAT |
| bacter_3_15 | CCTTGCCAATCACTCCCCAGGTGGA | plancto_3_15 | ATGTTTTCCTACGCCGTTAAGCTCAG | gamma_7_15 | CCCGGGTTGTCCCCACTCATGGGT |
| bacter_3_16 | GTAAGGCTCCTCGCCGTATCATCGA | plancto_3_16 | AACGCAGTGCCTCAGTTAAGCTCAG | gamma_7_16 | CCGGGTTGTCCCCACTCATGGGTA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| bacter_3_17 | CCGCCTACCCCAACTATACTCTAGA | plancto_3_17 | CAGTGCCTCAGTTAAGCTCAGGCAT | gamma_7_17 | CTCACCCGTATTAGGGGTAAGCCTT |
| bacter_3_18 | CCAGTAAGGCTCCTCGCCGTATCA | plancto_3_18 | CTGTCAACTCTGAGGGAGTACCCTC | gamma_7_18 | ACCCGTATTAGGGGTAAGCCTTCCT |
| bacter_3_19 | AAGGCTCCTCGCCGTATCATCGAAA | plancto_3_19 | CTCTGAGGGAGTACCCTCAGAGATT | gamma_7_19 | ACTCACCCGTATTAGGGGTAAGCCT |
| bacter_3_20 | GCCAATCACTCCCCAGGTGGATTAC | plancto_3_20 | TCTGTCAACTCTGAGGGAGTACCCT | gamma_7_20 | GTCAAGTACTCACCCGTATTAGGGG |
| bacter_3_21 | TAAGGCTCCTCGCCGTATCATCGAA | plancto_3_21 | GGAGTACCCTCAGAGATTTCATCCC | gamma_7_21 | TCACCCGTATTAGGGGTAAGCCTTC |
| bacter_3_22 | GCCCAGGTAAGGCTCCTCGCCGTAT | plancto_3_22 | CAAACGCAGTGCCTCAGTTAAGCTC | gamma_7_22 | CCCGTATTAGGGGTAAGCCTTCCTC |
| bacter_3_23 | CATTCCGCCTACCCCAACTATACTC | plancto_3_23 | CTCTGTCAACTCTGAGGGAGTACCC | gamma_7_23 | GTACTCACCCGTATTAGGGGTAAGC |
| bacter_3_24 | CAATCACTCCCCAGGTGGATTACCT | plancto_3_24 | ACAGCAGAAGAGAGAAACCTCCTCC | gamma_7_24 | CACCCGTATTAGGGGTAAGCCTTCC |
| bacter_3_25 | CCGCCGGAACTTTGATCATCAAGAG | plancto_3_25 | CTGAGGGAGTACCCTCAGAGATTTC | gamma_7_25 | TACTCACCCGTATTAGGGGTAAGCC |
| flavo_1_1 | CTCAGACACCAAGGTCCAAACAGCT | plancto_4_1 | ACTACCTAATATCGCATCGGCCGCT | gamma_8_1 | CGCGAGCTCATCATCAGCACAAGG |
| flavo_1_2 | CAGAGACACCAAGGTCCAAACAGTC | plancto_4_2 | CAACTACCTAATATCGCATCGGCCG | gamma_8_2 | TCATCATCAGCACAAGGTCCGAAG |
| flavo_1_3 | CACTCAGACACCAAGGTCCAAACAG | plancto_4_3 | AACTACCTAATATCGCATCGGCCGC | gamma_8_3 | CTCATCATCAGCACAAGGTCCGAA |
| flavo_1_4 | GCTTAGCCACTCAGACACCAAGGTC | plancto_4_4 | CCAACTACCTAATATCGCATCGCC | gamma_8_4 | GCTCATCATCAGCACACAAGGTCCGA |
| flavo_1_5 | ACTCAGACACCAAGGTCCAAACAGC | plancto_4_5 | ACGTTCCGATGTATTCCTACCCCGT | gamma_8_5 | ACGGAGCTCATCATCAGCACACAAG |
| flavo_1_6 | CTTAGCCACTCAGACACCAAGGTCC | plancto_4_6 | TACGTTCCGATGTATTCCTACCCCG | gamma_8_6 | CATCATCAGCACAAGGTCCGAAGA |
| flavo_1_7 | TACCGTCAAGCTTGTACACGTACC | plancto_4_7 | GTACGTTCCGATGTATTCCTACCCC | gamma_8_7 | GACGCGAGCTCATCATCAGCACAA |
| flavo_1_8 | GTACCGTCAAGCTTGTACACGTAC | plancto_4_8 | CTACCTAATATCGCATCGGCCGCTC | gamma_8_8 | GCGAGCTCATCATCAGCACAAGGT |
| flavo_1_9 | GCCACTCAGACACCAAGGTCCAAAC | plancto_4_9 | CGTTCCGATGTATTCCTACCCCGTT | gamma_8_9 | TCCATCAGCACAAGGTCCGAGATC |
| flavo_1_10 | TTAGCCACTCAGACACCAAGGTCCA | plancto_4_10 | GTTTCCACCACTAATCCGTGCATG | gamma_8_10 | CGACCGGAGCTCATCATCAGCACA |
| flavo_1_11 | ACCGTCAAGCTTGGTACACGTACCA | plancto_4_11 | TTCCACCCACTAATCCGTGCATGTC | gamma_8_11 | CATCAGCACAAGGTCCGAAGATCC |
| flavo_1_12 | CCACTCAGACACCAAGGTCCAAACA | plancto_4_12 | TCCACCCACTAATCCGTGCATGTCA | gamma_8_12 | CCCTCTAATGGGCAGATTCTCACGT |
| flavo_1_13 | AGCCACTCAGACACCAAGGTCCAAA | plancto_4_13 | CCACCCACTAATCCGTGCATGTCAA | gamma_8_13 | CCGACCGGAGCTCATCATCAGCAC |
| flavo_1_14 | TAGCCACTCAGACACCAAGGTCCAA | plancto_4_14 | GGCAGTAAACCTTTGGTCTCTGAC | gamma_8_14 | CCCCTCTAATGGGCAGATTCTCACG |
| flavo_1_15 | CCGTCAAGCTTGGTACACGTACCAA | plancto_4_15 | GGTACGTTCCGATGTATTCCTACCC | gamma_8_15 | CCCCCTCTAATGGGCAGATTCTCAC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_1_16 | CGCTTAGCCACTCAGACACCAAGGT | plancto_4_16 | TGCGAGCGTCATGAATGTTTCCACC | gamma_8_16 | CGAGCTCATCCATCAGCACAAGGTC |
| flavo_1_17 | TCGCTTAGCCACTCAGACACCAAGG | plancto_4_17 | GCGAGCGTCATGAATGTTTCCACCC | gamma_8_17 | CCATCAGCACAAGGTCCGAAGATCC |
| flavo_1_18 | CGTCAAGCTTGGTACACGTACCAAG | plancto_4_18 | GAGCGTCATGAATGTTTCCACCCAC | gamma_8_18 | CCTCTAATGGGCAGATTCTCACGTG |
| flavo_1_19 | CAGTAGTAACCATCGTTTACCGGC | plancto_4_19 | CGAGCGTCATGAATGTTTCCACCCA | gamma_8_19 | CCCAGGTTATCCCCTCTAATGGGC |
| flavo_1_20 | GCCATAGTAGAGACTATGGGGGAT | plancto_4_20 | CAGTTATGCCCCAGTGAATCGCCTT | gamma_8_20 | TCCGACGCGAGCTCATCCATCAGCA |
| flavo_1_21 | TGCCATAGTAGAGACTATGGGGGA | plancto_4_21 | TCAGTTATGCCCCAGTGAATCGCCT | gamma_8_21 | GAGCTCATCCATCAGCACAAGGTCC |
| flavo_1_22 | ATGCCATAGCTAGAGACTATGGGGG | plancto_4_22 | AGTTATGCCCCAGTGAATCGCCTTC | gamma_8_22 | TTCCCCAGGTTATCCCCTCTAATG |
| flavo_1_23 | TTCGCTTAGCCACTCAGACACCAAG | plancto_4_23 | GTCAGTTATGCCCCAGTGAATCGCC | gamma_8_23 | TCCCCAGGTTATCCCCTCTAATGG |
| flavo_1_24 | AGCTAGTAACCATCGTTTACCGGCG | plancto_4_24 | GTTATGCCCCAGTGAATCGCCTTCG | gamma_8_24 | CCCCAGGTTATCCCCTCTAATGGG |
| flavo_1_25 | GTCAAGCTTGGTACACGTACCAAGG | plancto_4_25 | CTCCACTGGATGTTCCATTCACCTC | gamma_8_25 | ATCCCCCTCTAATGGGCAGATTCTC |
| flavo_2_1 | TACAGTACCGTCAGAGCTCTACACG | alpha_1_1 | CCGGCCCCTTGCGGGAAGAAAGCCA | gamma_9_1 | CCTGTCCATCGGTTCCCGAAGGCAC |
| flavo_2_2 | TCTTACAGTACCGTCAGAGCTCTAC | alpha_1_2 | CACCTGTGCACCGGCCCCTTGCGGG | gamma_9_2 | CTGTCCATCGGTTCCCGAAGGCACC |
| flavo_2_3 | TTACAGTACCGTCAGAGCTCTACA | alpha_1_3 | GCACCTGTGCACCGGCCCCTTGCGG | gamma_9_3 | TGTCCATCGGTTCCCGAAGGCACCA |
| flavo_2_4 | GCATACTCATCTCTTACCGCCGAAG | alpha_1_4 | CTGTGCACCGGCCCCTTGCGGGAAG | gamma_9_4 | CAGCACCTGTCATCGGTTCCCGAA |
| flavo_2_5 | CATACTCATCTCTTACCGCCGAAGC | alpha_1_5 | ACCTGTGCACCGGCCCCTTGCGGGA | gamma_9_5 | AGCACCTGTCCATCGGTTCCCGAAG |
| flavo_2_6 | ACAGTACCGTCAGAGCTCTACACGT | alpha_1_6 | CCTGTGCACCGGCCCCTTGCGGGAA | gamma_9_6 | ACCTGTCCATCGGTTCCCGAAGGCA |
| flavo_2_7 | CAGTACCGTCAGAGCTCTACACGTA | alpha_1_7 | AGCACCTGTGCACCGGCCCCTTGCG | gamma_9_7 | GTCCATCGGTTCCCGAAGGCACCAA |
| flavo_2_8 | CTTACAGTACCGTCAGAGCTCTACA | alpha_1_8 | CGGCCCCTTGCGGGAAGAAAGCCAT | gamma_9_8 | CACCTGTCCATCGGTTCCCGAAGGC |
| flavo_2_9 | TACTTCATCTCTTACCGCCGAAGCTT | alpha_1_9 | GCACCGGCCCCTTGCGGGAAGAAAG | gamma_9_9 | CCTCCCTCTCTCGCACTCTAGCCTT |
| flavo_2_10 | ATATCATCTCTTACCGCCGAAGCT | alpha_1_10 | CACCGGCCCCTTGCGGGAAGAAAGC | gamma_9_10 | GCAACCTGTCCATCGGTTCCCGAAGG |
| flavo_2_11 | CTCATCTCTTACCGCCGAAGCTTTA | alpha_1_11 | ACCGGCCCCTTGCGGGAAGAAAGCC | gamma_9_11 | GCAGACCTGTCCATCGGTTCCCGA |
| flavo_2_12 | CGCCCAGTGGCTGCTCTCTGTCTAT | alpha_1_12 | TGTGCACCGGCCCCTTGCGGGAAGA | gamma_9_12 | ACCTCCCTCTCTCGCACTCTAGCCT |
| flavo_2_13 | CCAGTGGCTGCTCTCTGTCTATACC | alpha_1_13 | GTGCACCGGCCCCTTGCGGGAAGAA | gamma_9_13 | CTCCCTCTCTCGCACTCTAGCCTTC |
| flavo_2_14 | CCCAGTGGCTGCTCTCTGTCTATAC | alpha_1_14 | TGCACCGGCCCCTTGCGGGAAGAAA | gamma_9_14 | TCTCTGCACTCTAGCCTTCAGTA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_2_15 | TCGCCCAGTGGCTGCTCTGTCTA | alpha_1_15 | CAGCACCTGTGCACCGGCCCCTTGC | gamma_9_15 | TCGCACTCTAGCCTTCCAGTATCGG |
| flavo_2_16 | GCCCAGTGGCTGCTCTCTGTCTATA | alpha_1_16 | TTGCGGGAAGAAAGCCATCTCTGGC | gamma_9_16 | CTCGCACTCTAGCCTTCCAGTATCG |
| flavo_2_17 | GACTTCGATCCGAACTGTGATATAG | alpha_1_17 | GGCCCCTTGCGGGAAGAAAGCCATC | gamma_9_17 | TACCTCCCTCTCTCGCACTCTAGCC |
| flavo_2_18 | AGAACGCATACTCATCTCTTACCGC | alpha_1_18 | CCTTGCGGGAAGAAAGCCATCTCTG | gamma_9_18 | CTCTCGCACTCTAGCCTTCCAGTAT |
| flavo_2_19 | GAACGCATATCATCTCTTACCGCC | alpha_1_19 | GCAGCACCTGTGCACCGGCCCCTTG | gamma_9_19 | CCCTCTCTCGCACTCTAGCCTTCCA |
| flavo_2_20 | CACGTAGAGCGGTTTCTTCCTGTAT | alpha_1_20 | TGCGGGAAGAAAGCCATCTCTGGCG | gamma_9_20 | TGCAGCACCTGTCCATCGGTTCCCG |
| flavo_2_21 | GTCCTGTCACACTACATTTAAGCCC | alpha_1_21 | AAAGCCATCTCTGGCGATCATACCG | gamma_9_21 | ACTCCGTGGTAATCGCCCTCCCGAA |
| flavo_2_22 | ACTCATCTCTTACCGCCGAAGCTTT | alpha_1_22 | GCCCCTTGCGGGAAGAAAGCCATCT | gamma_9_22 | TCCATCGGTTCCCGAAGGCACCAAT |
| flavo_2_23 | CCCTATCTATCGTAGCCATGGTGT | alpha_1_23 | AACAGCAAGCTGCCCAACGGCTAGC | gamma_9_23 | TCACTCCGTGTAATCGCCCTCCCG |
| flavo_2_24 | CCCTATCTATCGTAGCCATGGTGTG | alpha_1_24 | CATGCAGCACCTGTGCACCGGCCCC | gamma_9_24 | TCCCTCTCTCGCACTCTAGCCTTCC |
| flavo_2_25 | CCTATCTATCGTAGCCATGTGTGC | alpha_1_25 | GCAAGCTGCCCAACGGCTAGCATCC | gamma_9_25 | CCTCTCTCGCACTCTAGCCTTCCAG |
| flavo_3_1 | CTGTCACCTAACATTTAAGCCCTGG | alpha_2_1 | GTGACCCAGAAAGTTGCCTTCGCAT | gamma_10_1 | CGCAGGCACATCCGATAGCGAGAGC |
| flavo_3_2 | CCGTCAAGCTTTCTCACGAGAAAGT | alpha_2_2 | GTATTCACCGCGACGCCTGATTCG | gamma_10_2 | ACGCAGGCACATCCGATAGCGAGAG |
| flavo_3_3 | ACCGTCAAGCTTTCTCACGAGAAAG | alpha_2_3 | CGTATTCACCGCGACGGCTGATTC | gamma_10_3 | GCGGCTTCGCGCGCCCTCTGTACTTG |
| flavo_3_4 | CTCTGACTTATTTGTCCACCTACGG | alpha_2_4 | TATTCACCGCGACGCGTGATTCGC | gamma_10_4 | CGGCTTCGCGCGCCCTCTGTACTTGC |
| flavo_3_5 | CCTCTGACTTATTTGTCCACCTACG | alpha_2_5 | ACGTATTCACCGCGACGCGCTGATT | gamma_10_5 | GGCTTCGCGGCCCTCTGTACTTGC |
| flavo_3_6 | GTACCGTCAAGCTTTCTCACGAGAA | alpha_2_6 | GGAACGTATTCACCGCGACGCGCTG | gamma_10_6 | CGCGGCTTCGCGCCCTCTGTACTT |
| flavo_3_7 | GAGGCAGATTGTATACGCGATACTC | alpha_2_7 | CCGGAACGTATTCACCGCGACGCG | gamma_10_7 | GCTTCGCGGCCCTCTGTACTTGCCA |
| flavo_3_8 | TCTATCGTAGCCTAGGTGTGCCGTT | alpha_2_8 | CGGGAACGTATTCACCGCGACGACGC | gamma_10_8 | CACTACTGGGTAGTTTCCTACGCGT |
| flavo_3_9 | CCCCTATCGTAGCCTAGGTGTGT | alpha_2_9 | GGGAACGTATTCACCGCGACGACGCT | gamma_10_9 | CCAACTACTGGGTAGTTTCCTACGCG |
| flavo_3_10 | ATCTATCGTAGCCTAGGTGTGCCGT | alpha_2_10 | AACGTATTCACCGCGACGCGCTGAT | gamma_10_10 | CCCCACTACTGGGTAGTTCCTACG |
| flavo_3_11 | CCCTATCTATCGTAGCCTAGGTGTG | alpha_2_11 | GAACGTATTCACCGCGACGCGCTGA | gamma_10_11 | CCCACTACTGGGTAGTTTCCTACGC |
| flavo_3_12 | TATCTATCGTAGCCTAGGTGTGCCG | alpha_2_12 | CCCGGGAACGTATTCACCGCGACGC | gamma_10_12 | CCCCCACTACTGGGTAGTTCCTAC |
| flavo_3_13 | CCTATCTATCGTAGCCTAGGTGTGC | alpha_2_13 | ATTCACCGCGACGCGCTGATTCGCG | gamma_10_13 | ACTACCGGGTAGTTTCCTACGCGTT |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_3_14 | CTATCTATCGTAGCCTAGGTGTGCC | alpha_2_14 | CCGCGACGCGCTGATTCGCGATTAC | gamma_10_14 | CACTACCGGGTAGTTTCCTACGCGT |
| flavo_3_15 | CTATCGTAGCCTAGGTGTGCCGTTA | alpha_2_15 | CACCGCGACGCGCTGATTCGCGATT | gamma_10_15 | ACCGGGTAGTTTCCTACGCGTTACT |
| flavo_3_16 | TATCGTAGCCTAGGTGTGCCGTTAC | alpha_2_16 | CGCGACGCGCTGATTCGCGATTACT | gamma_10_16 | CCACTACCGGGTAGTTTCCTACGCG |
| flavo_3_17 | CTTATTGTCCACCTACGGACCCTT | alpha_2_17 | TCACCGCGACGCGCTGATTCGCGAT | gamma_10_17 | CCCCACTACCGGGTAGTTTCCTACG |
| flavo_3_18 | ACTTATTGTCCACCTACGGACCCT | alpha_2_18 | ACCGCGACGCGCTGATTCGCGATTA | gamma_10_18 | CCGGGTAGTTTCCTACGCGTTACTC |
| flavo_3_19 | GACTTATTGTCCACCTACGGACCC | alpha_2_19 | GCGACGCGCTGATTCGCGATTACTA | gamma_10_19 | CCCACTACCGGGTAGTTTCCTACGC |
| flavo_3_20 | TGACTTATTGTCCACCTACGGACC | alpha_2_20 | TTCACCGCGACGCGCTGATTCGCGA | gamma_10_20 | TACCGGGTAGTTTCCTACGCGTTAC |
| flavo_3_21 | CTGACTTATTGTCCACCTACGGAC | alpha_2_21 | TCCTCAGTGTCAGTAGTGACCCAGA | gamma_10_21 | CCCCACTACCGGGTAGTTTCCTAC |
| flavo_3_22 | AGATTGTATACGCGATACTCACCCG | alpha_2_22 | CCCAGAAAGTTGCCTTCGCATTTGG | gamma_10_22 | CTACCGGGTAGTTTCCTACGCGTTA |
| flavo_3_23 | GATTGTATACGCGATACTCACCCGT | alpha_2_23 | AGTGCGGGCTCATCTTTCGGCGTAT | gamma_10_23 | CTGTTGTCCCCCACTACTGGGTAGT |
| flavo_3_24 | TCTTCGGGCTATTCCCTAGTATGAG | alpha_2_24 | AAGTGCGGGCTCATCTTTCGGCGTA | gamma_10_24 | CTAGCTAATCTCACGCAGGCACATC |
| flavo_3_25 | CTTCGGGCTATTCCCTAGTATGAGG | alpha_2_25 | GTGCGGGCTCATCTTTCGGCGTATA | gamma_10_25 | CAACTAGCTAATCTCACGCAGGCAC |
| flavo_4_1 | CAGGAGATATTCCCATACTATGGGG | alpha_3_1 | CACCTGTATCCAATCACCCGAAGT | gamma_11_1 | GCTTTCCCCCGTAGGATATATGCGG |
| flavo_4_2 | TCAAACTCCCACACGTGGGAGTGGT | alpha_3_2 | ACCTGTATCCAATCACCCGAAGTG | gamma_11_2 | CTTTCCCCCGTAGGATATATGCGGT |
| flavo_4_3 | CAAACTCCCACACGTGGGAGTGGTT | alpha_3_3 | CCTGTATCCAATCACCCGAAGTGA | gamma_11_3 | TGCTTTCCCCCGTAGGATATATGCG |
| flavo_4_4 | GTCAAACTCCCACACGTGGGAGTGG | alpha_3_4 | GCACCTGTATCCAATCACCCGAAG | gamma_11_4 | CTGCTTTCCCCCGTAGGATATATGC |
| flavo_4_5 | GGAGATATTCCCATACTATGGGGCA | alpha_3_5 | GGCAGTTCCTTCCAAAGTTCCCACCA | gamma_11_5 | CCTGCTTTCCCCCGTAGGATATATG |
| flavo_4_6 | AGGAGATATTCCCATACTATGGGGC | alpha_3_6 | AGCACCTGTATCCAATCACCCGAA | gamma_11_6 | CCCTGCTTTCCCCCGTAGGATATAT |
| flavo_4_7 | CGTCAAACTCCCACACGTGGGAGTG | alpha_3_7 | CGGCAGTTCCTTCCAAAGTTCCACC | gamma_11_7 | CTCACTCAGGCTCATCAAAATAGCGC |
| flavo_4_8 | AAAACTCCCACACGTGGGAGTGGTTC | alpha_3_8 | CAGCACCTGTATCCAATCACCCGA | gamma_11_8 | CCCCTGCTTTCCCCCGTAGGATATA |
| flavo_4_9 | CTGGGCTATTCCCTCCAAAAGGTA | alpha_3_9 | CCGGCAGTTCCTTCCAAAGTTCCAC | gamma_11_9 | GTGTCAGTATCGAGCCAGTCAGTCG |
| flavo_4_10 | CCGTCAAACTCCCACACGTGGGAGT | alpha_3_10 | GCAGCACCTGTATCCAATCACCCG | gamma_11_10 | TCAGTGTCAGTATCGAGCCAGTCAG |
| flavo_4_11 | CTTAACCACTCAGCCCTTAATCGG | alpha_3_11 | TGCAGCACCTGTATCCAATCACCCC | gamma_11_11 | AGTGTCAGTATCGAGCCAGTCAGTC |
| flavo_4_12 | GTTTCCCTGGGCTATTCCCCTCCAA | alpha_3_12 | TCACCCGGCAGTTCCTTCCAAAGTTCC | gamma_11_12 | TGTCAGTATCGAGCCAGTCAGTCGC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_4_13 | GCTTAACCACTCAGCCCTTAATCGG | alpha_3_13 | CTTACAAATCCGCCTACGCTCGCTT | gamma_11_13 | CAGTGTCAGTATCGAGCCAGTCAGT |
| flavo_4_14 | AACTCCCACACGTGGGAGTGGTTCT | alpha_3_14 | ATGCAGCACCTGTATCCAATCCACC | gamma_11_14 | CTCAGTGTCAGTATCGAGCCAGTCA |
| flavo_4_15 | ACCGTCAAACTCCCACACGTGGGAG | alpha_3_15 | CGGGCCCATCCAATAGCGCATAAAG | gamma_11_15 | TCCCCTGCTTTCCCCCGTAGGATAT |
| flavo_4_16 | CCACACGTGGGAGTGGTTCTTCCTC | alpha_3_16 | GGGCCCATCCAATAGCGCATAAAGC | gamma_11_16 | CCCCACCAACTAGCTAATCTCACTC |
| flavo_4_17 | AGTTTCCCTGGGCTATTCCCCTCCA | alpha_3_17 | GCGGGCCCATCCAATAGCGCATAAA | gamma_11_17 | CCTCAGTGTCAGTATCGAGCCAGTC |
| flavo_4_18 | TTAACCACTCAGCCCTTAATCGGGC | alpha_3_18 | ACTTACAAATCCGCCTACGCTCGCT | gamma_11_18 | GTCCCCTGCTTTCCCCCGTAGGATA |
| flavo_4_19 | CACGTGGGAGTGGTTCTTCCTCTGT | alpha_3_19 | CGCGGGCCCATCCAATAGCGCATAA | gamma_11_19 | TCAGTATCGAGCCAGTCAGTCGCCT |
| flavo_4_20 | CACACGTGGGAGTGGTTCTTCCTCT | alpha_3_20 | GGCCCATCCAATAGCGCATAAAGCT | gamma_11_20 | GTATCGAGCCAGTCAGTCAGTCGCCTTCG |
| flavo_4_21 | ACAGTGGGAGTGGTTCTTCCTCTG | alpha_3_21 | CACCGGCAGTTCCTTCAAAGTTCCC | gamma_11_21 | AGTATCGAGCCAGTCAGTCGCCTTC |
| flavo_4_22 | CGCTTAACCACTCAGCCCTTAATCG | alpha_3_22 | ACCGGCAGTTCCTTCAAAGTTCCCA | gamma_11_22 | TATCGAGCCAGTCAGTCGCCTTCGC |
| flavo_4_23 | ACGTGGGAGTGGTTCTTCCTCTGTA | alpha_3_23 | AACTTACAAATCCGCCTACGCTCGC | gamma_11_23 | ATCGAGCCAGTCAGTCGCCTTCGCC |
| flavo_4_24 | TTTCCCTGGGCTATTCCCCTCCAAA | alpha_3_24 | CGATAAAGCTTTTCTCCCGAAGGAC | gamma_11_24 | GTCAGTATCGAGCCAGTCAGTCGCC |
| flavo_4_25 | TTCCCTGGGCTATTCCCCTCCAAAA | alpha_3_25 | CATGCAGCACCTGTATCCAATCCAC | gamma_11_25 | CAGTATCGAGCCAGTCAGTCGCCTT |
| flavo_5_1 | CGTCAACAGTTCACACGTGAACCTT | roseo_1_1 | CTCTGGAATCCGCGACAAGTATGTC | gamma_12_1 | CACTACCTGGTAGATTCCTACGCGT |
| flavo_5_2 | ACAGTACCGTCAACAGTTCACACGT | roseo_1_2 | TGCCCCTATAAATAGTTGGCGCACC | gamma_12_2 | CCACTACCTGGTAGATTCCTACGCG |
| flavo_5_3 | CCGTCAACAGTTCACACGTGAACCT | roseo_1_3 | CCCTATAAATAGTTGGCGCACCACC | gamma_12_3 | CCCACTACCTGGTAGATTCCTACGC |
| flavo_5_4 | CAGTACCGTCAACAGTTCACACGTG | roseo_1_4 | CCCCTATAAATAGTTGGCGCACCAC | gamma_12_4 | AACTGTTGTCCCCACTACCTGGTA |
| flavo_5_5 | TACAGTACCGTCAACAGTTCACACG | roseo_1_5 | GCCCCTATAAATAGTTGGCGCACCA | gamma_12_5 | CAACTGTTGTCCCCACTACCTGGT |
| flavo_5_6 | ACCGTCAACAGTTCACACGTGAACC | roseo_1_6 | CGTGGTTGGCTGCCCCTATAAATAG | gamma_12_6 | CCAACTGTTGTCCCCACTACCTGG |
| flavo_5_7 | CTACAGTACCGTCAACAGTTCACAC | roseo_1_7 | CTGCCCTATAAATAGTTGGCGCAC | gamma_12_7 | CCCCACTACCTGGTAGATTCCTACG |
| flavo_5_8 | TACCGTCAACAGTTCACACGTGAAC | roseo_1_8 | CCGTGGTTGGCTGCCCCTATAAATA | gamma_12_8 | CGGTATTGCAACCCTCGTACGCCC |
| flavo_5_9 | AGTACCGTCAACAGTTCACACGTGA | roseo_1_9 | TGGCTGCCCCTATAAAATAGTTGGCG | gamma_12_9 | ACTGTTGTCCCCACTACCTGGTAG |
| flavo_5_10 | GTACCGTCAACAGTTCACACGTGAA | roseo_1_10 | GGCTGCCCCTATAAATAGTTGGCGC | gamma_12_10 | TCCAACTGTTGTCCCCACTACCTG |
| flavo_5_11 | CCTACAGTACCGTCAACAGTTCACA | roseo_1_11 | GGAATCCGCGACAAGTATGTCAAGG | gamma_12_11 | CCCCACTACCTGGTAGATTCCTAC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_5_12 | TCCTACAGTACCGTCAACAGTTCAC | roseo_1_12 | GCTGCCCTATAAATAGTTGGGCCA | gamma_12_12 | GCGGTATTGCAACCCTCTGTACGCC |
| flavo_5_13 | CCGAAGAAAAGATGTTTCCACCCC | roseo_1_13 | ACCGTGGTTGGCTGCCCTATAAAT | gamma_12_13 | GCGGTATCGCAACCCTCTGTACGTT |
| flavo_5_14 | CTCAGACCCGCAATTAGTCCGAACAG | roseo_1_14 | CCATCTCTGGAATCCGCGACAAGTA | gamma_12_14 | TCTATCAGTTTGGGTGCAGTTCCC |
| flavo_5_15 | TAGCCACTCAGACCCGCAATTAGTCC | roseo_1_15 | ATAGTTGGCGCACCACCTTCGGGTA | gamma_12_15 | GTCTATCAGTTTGGGGTGCAGTTCC |
| flavo_5_16 | TTAGCCACTCAGACCCGCAATTAGTC | roseo_1_16 | GGAATCCATCTCTGGAATCCGGCAC | gamma_12_16 | CTGTTGTCCCCACTACCTGGTAGA |
| flavo_5_17 | ACTCAGACCCGCAATTAGTCCGAACA | roseo_1_17 | TACCGTGGTTGGCTGCCCTATAAA | gamma_12_17 | CTATCAGTTTGGGGTGCAGTTCCCA |
| flavo_5_18 | AGATGTTTCCACCCCTGTCAAACTG | roseo_1_18 | GAATCCGCGACAAGTATGTCAAGGG | gamma_12_18 | CTGTTGCTAACGTCACAGCTAAGGG |
| flavo_5_19 | CAGACCGCAATTAGTCCGAACAGCT | roseo_1_19 | TCCATCTCTGGAATCCGCGACAAGT | gamma_12_19 | CAGTTTGGGGTGCAGTTCCCAGGTT |
| flavo_5_20 | GCCACTCAGACCCGCAATTAGTCCGA | roseo_1_20 | ATCCATCTCTGGAATCCGCGGGTAG | gamma_12_20 | AGTTTGGGGTGCAGTTCCCAGGTTG |
| flavo_5_21 | CACTCAGACCCGCAATTAGTCCGAAC | roseo_1_21 | TAGTTGGCGCACCACCTTCGGGTAG | gamma_12_22 | TTCCAACTGTTGTCCCCACTACCT |
| flavo_5_22 | CTTAGCCACTCAGACCGCAATTAGT | roseo_1_22 | CCTACCGTGGTTGGCTGCCCTATA | gamma_12_22 | TATCAGTTTGGGGTGCAGTTCCCAG |
| flavo_5_23 | AGCCACTCAGACCCGCAATTAGTCCG | roseo_1_23 | CTACCGTGGTTGGCTGCCCTATAAA | gamma_12_23 | CGGTATCGCAACCCTCTGTACGTTC |
| flavo_5_24 | TCAGACCGCAATTAGTCCGAACAGC | roseo_1_24 | ACGTCGTCCACACCTTCCTCCGCT | gamma_12_24 | CCCCACCAACTAACTAATCTCACGC |
| flavo_5_25 | ACTTTCGCTTAGCCACTCAGACCGC | roseo_1_25 | GACGTCGTCCACACCTTCCTCCGGC | gamma_12_25 | GTCAGCGACTAGCAAGCTAGTCCTG |
| flavo_6_1 | AGTGCCGGAGTTAAGCCCCTGCATT | roseo_2_1 | GTCACCGGGTCACCGAAGTGAAAAC | gamma_13_1 | CGCCACTGAAAGACATTGTCTCCA |
| flavo_6_2 | GTGCCGGAGTTAAGCCCCTGCATTT | roseo_2_2 | ACCGGGTCACCGAAGTGAAAACCAG | gamma_13_2 | GCGCCACTGAAAGACATTGTCTCCC |
| flavo_6_3 | CAGTGCCGGAGTTAAGCCCCTGCAT | roseo_2_3 | CACCGGGTCACCGAAGTGAAAACCA | gamma_13_3 | TGCGCCACTGAAAGACATTGTCTCC |
| flavo_6_4 | TGCCGGAGTTAAGCCCCTGCATTTC | roseo_2_4 | TCACCGGGTCACCGAAGTGAAAACC | gamma_13_4 | TGTCAGTACAGATCAGGAGGCGC |
| flavo_6_5 | AGTTAAGCCCCTGCATTTCACCACT | roseo_2_5 | TGTCACCGGGTCACCGAAGTGAAAA | gamma_13_5 | GTGTCAGTACAGATCAGGAGGAGGCCG |
| flavo_6_6 | GCAGTGCCGGAGTTAAGCCCCTGCA | roseo_2_6 | CCGGGTCACCGAAGTGAAAACCAGA | gamma_13_6 | CTGCGCCACTGAAAGACATTGTCTC |
| flavo_6_7 | GTTAAGCCCCTGCATTTCACCACTG | roseo_2_7 | AGATCTCTGGCGGTCCCGGGATG | gamma_13_7 | CTTGGCTCCAAAAGGCACACTCTCA |
| flavo_6_8 | GGCAGTGCCGGAGTTAAGCCCCTGC | roseo_2_8 | ACCAGATCTCTGGCGGTCCCGGG | gamma_13_8 | GAGAGCTTCAAGAGAGGCCCTCTTT |
| flavo_6_9 | TGGCAGTGCCGGAGTTAAGCCCCTG | roseo_2_9 | AACCAGATCTCTGGCGGTCCCGG | gamma_13_9 | CGAGAGCTTCAAGAGAGGCCCTCTT |
| flavo_6_10 | GAGTTAAGCCCCTGCATTTCACCAC | roseo_2_10 | AAACCAGATCTCTGGCGGTCCCG | gamma_13_10 | GCGAGAGCTTCAAGAGAGGCCCTCT |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_6_11 | GCCGGAGTTAAGCCCTGCATTTCA | roseo_2_11 | TCTCTGGCGGTCCCGGGATGTCAAG | gamma_13_11 | TAGCGAGAGCTTCAAGAGAGCCCT |
| flavo_6_12 | ATGGCAGTGCCGGAGTTAAGCCCCT | roseo_2_12 | ATCTCTCTGGCGGTCCCGGGATGTC | gamma_13_12 | AGAGCTTCAAGAGAGCCCTCTTTC |
| flavo_6_13 | TTAAGCCCCTGCATTTCACCACTGA | roseo_2_13 | GATCTCTCTGGCGGTCCCGGGATGT | gamma_13_13 | AGCGAGAGCTTCAAGAGAGCCCTC |
| flavo_6_14 | GGAGTTAAGCCCCTGCATTTCACCA | roseo_2_14 | CAGATCTCTCTGGCGGTCCCGGGAT | gamma_13_14 | GTCAGTACAGATCCAGGAGGCCGC |
| flavo_6_15 | CGGAGTTAAGCCCCTGCATTTCACC | roseo_2_15 | TCTGGCGGTCCCGGGATGTCAAGGG | gamma_13_15 | TCAGTACAGATCCAGGAGGCCGCT |
| flavo_6_16 | CCCTGCATTTCACCACTGACTTATC | roseo_2_16 | CTCTGGCGGTCCCGGGATGTCAAGG | gamma_13_16 | CAGTACAGATCCAGGAGGCCCGCTT |
| flavo_6_17 | CAATGGCAGTGCCGGAGTTAAGCCC | roseo_2_17 | CCAGATCTCTCTGGCGGTCCCGGGA | gamma_13_17 | AGTACAGATCCAGGAGGCCGCCTC |
| flavo_6_18 | TCAATGGCAGTGCCGGAGTTAAGCC | roseo_2_18 | TCTCTCTGGCGGTCCCGGGATGTCA | gamma_13_18 | GCTGCCCACTGAAAGACATTGTCT |
| flavo_6_19 | CCTTACGGTCACCGACTTCAGGCAC | roseo_2_19 | CTCTCTGGCGGTCCCGGGATGTCAA | gamma_13_19 | GAGCTTCAAGAGAGGCCCTCTTTCT |
| flavo_6_20 | CCGGAGTTAAGCCCCTGCATTTCAC | roseo_2_20 | CTGGCGGTCCCGGGATGTCAAGGGT | gamma_13_20 | TCTTGGCTCCAAAAGGCACACTCTC |
| flavo_6_21 | AATGGCAGTGCCGGAGTTAAGCCCC | roseo_2_21 | ACCTGTCACCGGGTCACCGAAGTGA | gamma_13_21 | AGTGTCAGTACAGATCCAGGAGGCC |
| flavo_6_22 | TATCAATGGCAGTGCCGGAGTTAAG | roseo_2_22 | CCTGTCACCGGGTCACCGAAGTGAA | gamma_13_22 | GGCCCTCTTTCTCCCTTAGGAGGTA |
| flavo_6_23 | GTATCAATGGCAGTGCCGGAGTTAA | roseo_2_23 | CTGTCACCGGGTCACCGAAGTGAAA | gamma_13_23 | AGCTTCAAGAGAGGCCCTCTTTCTC |
| flavo_6_24 | CCCCTGCATTTCACCACTGACTTAT | roseo_2_24 | CGGGTCACCGAAGTGAAAACCAGAT | gamma_13_24 | AGCTGCGCCACTGAAAGACATTGTC |
| flavo_6_25 | TAAGCCCCTGCATTTCACCACTGAC | roseo_2_25 | AAAAACCAGATCTCTCTGGCGGTCC | gamma_13_25 | CGAGAGCATCAAGAGAGGCCCTCTT |
| flavo_7_1 | TCTTACAGTACCGTCACCAGACTAC | roseo_3_1 | GCCGCTACACCCGAAGGTGCCGCTC | gamma_14_1 | GGCGGTCAACTTACTACGTTAGCTG |
| flavo_7_2 | CTTACAGTACCGTCACCAGACTACA | roseo_3_2 | CTACACCCGAAGGTGCCGCTCGACT | gamma_14_2 | CCAGGCGGTCAACTTACTACGTTAG |
| flavo_7_3 | CGTCACCAGACTACACGTAGTCCTT | roseo_3_3 | GCTACACCCGAAGGTGCCGCTCGAC | gamma_14_3 | GCGGTCAACTTACTACGTTAGCTGC |
| flavo_7_4 | GTACCGTCACCAGACTACACGTAGT | roseo_3_4 | CCGGCTACACCCGAAGGTGCCGCTCG | gamma_14_4 | CAGGGCGGTCAACTTACTACGTTAGC |
| flavo_7_5 | CCGTCACCAGACTACACGTAGTCCT | roseo_3_5 | CGCTACACCCGAAGGTGCCGCTCGA | gamma_14_5 | CCCAGGCGGTCAACTTACTACGTTA |
| flavo_7_6 | TACCGTCACCAGACTACACGTAGTC | roseo_3_6 | CGCCGCTACACCCGAAGGTGCCGCT | gamma_14_6 | CCGAGGGCACTGCTTCATTACAAAG |
| flavo_7_7 | ACCGTCACCAGACTACACGTAGTCC | roseo_3_7 | CCGCCGCTACACCCGAAGGTGCCGC | gamma_14_7 | CGAGGGCACTGCTTCATTACAAAGC |
| flavo_7_8 | TTACAGTACCGTCACCAGACTACAC | roseo_3_8 | TACACCCGCTACACCCGAAGGTGCCGCTT ? | gamma_14_8 | TCCCGAGGGCACTGCTTCATTACAA |
| flavo_7_9 | GTCACCAGACTACACGTAGTCCTTA | roseo_3_9 | TCCGCCGCTACACCCGAAGGTGCCG | gamma_14_9 | CCCGAGGGCACTGCTTCATTACAAA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_7_10 | TACAGTACCGTCACCAGACTACACG | roseo_3_10 | ACACCCGAAGGTGCCGCTCGACTTG | gamma_14_10 | CCCCAGGCGGTCAACTTACTACGTT |
| flavo_7_11 | ACAGTACCGTCACCAGACTACACGT | roseo_3_11 | GTCCGCCGCTACACCCGAAGGTGCC | gamma_14_11 | TCCCCAGGCGGTCAACTTACTACGT |
| flavo_7_12 | AACTTTCACCCCTGACTTAACAGCC | roseo_3_12 | ACCCGAAGGTGCCGCTCGACTTGCA | gamma_14_12 | CTCCCGAGGGCACTGCTTCATTACA |
| flavo_7_13 | CAGTACCGGTCACCAGACTACACGTA | roseo_3_13 | CACCCGCGCTACACCCGAAGGTGC | gamma_14_13 | CTCCCCAGGCGGTCAACTTACTACG |
| flavo_7_14 | CCGGTCGTCAGCAAGAGCAAGCTCC | roseo_3_14 | CGTCCGCGCTACACCCGAAGGTGC | gamma_14_14 | GCTCCCGAGGGCACTGCTTCATTAC |
| flavo_7_15 | ACTTTCACCCCTGACTTAACAGCCC | roseo_3_15 | CACCTGGTCTCTTACGACGAAAACCG | gamma_14_15 | TCTTGGCTCCCGAGGGCACTGCTTC |
| flavo_7_16 | CCCTGACTTAACAGCCCGCCTACG | roseo_3_16 | CCAGGAGTTTTGGAGGCCGTTCCAG | gamma_14_16 | GGCTCCCGAGGGCACTGCTTCATTA |
| flavo_7_17 | TCGCTTGGCCGCTCAGATCGAAATC | roseo_3_47 | ACCTGGTCTCTTACGAGAAAACCGG | gamma_14_47 | TATCTTGGCTCCCGAGGGCACTGCT |
| flavo_7_18 | CGCTTGGCCGCTCAGATCGAAATCG | roseo_3_18 | CCGGATCTCTTCCGGCGGTCCAGGA | gamma_14_18 | ACTCCCCAGGCGGTCAACTTACTAC |
| flavo_7_19 | TTCGCTTGGCCGCTCAGATCGAAAT | roseo_3_19 | CCCGAAGGTGCCCCTCGACTTGCAT | gamma_14_19 | ATCTTGGCTCCCGAGGGCACTGCTT |
| flavo_7_20 | TTTCGCTTGGCCGCTCAGATCGAAA | roseo_3_20 | ACCAGGAGTTTTGGAGGCCGTTCCA | gamma_14_20 | TACTACGTTAGCTGCGCCACTGAGA |
| flavo_7_21 | GCTTGGCCGCTCAGATCGAAATCCA | roseo_3_21 | CAGGAGTTTTGGAGGCCGTTCCAGG | gamma_14_21 | GTATCTTGGCTCCCGAGGGCACTGC |
| flavo_7_22 | CTTGGCCGCTCAGATCGAAATCCAA | roseo_3_22 | CCGAAGGTGCCCCTCGACTTGCATG | gamma_14_22 | CTTGGCTCCCGAGGGCACTGCTTCA |
| flavo_7_23 | TTGGCCGCTCAGATCGAAATCCAAA | roseo_3_23 | CCGTCCGCCGCTACACCCGAAGGTG | gamma_14_23 | TGGCTCCCGAGGGCACTGCTTCATT |
| flavo_7_24 | GGCTATCCCTTAGTGTAAGGCAGCA | roseo_3_24 | AAACCGGATCTCTTCCGGCGCGTCCAG | gamma_14_24 | ACTACGTTAGCTGCCACTGAGAA |
| flavo_7_25 | GGGCTATCCCTTAGTGTAAGGCAGA | roseo_3_25 | CCTGGTCTCTTACGAGAAAACCGGA | gamma_14_25 | TTGGCTCCCGAGGGCACTGCTTCAT |
| flavo_8_1 | GCCGAAATACGGTACTACGGGGCAT | roseo_4_1 | CGTACCATCTCTGGTAGTAGCACAG | gamma_15_1 | TCCGTAGAAGTCCGGCCGTGTCTC |
| flavo_8_2 | GATGCCGAAATACGGTACTACGGGG | roseo_4_2 | CCATCTCTGGTAGTAGCACAGGATG | gamma_15_2 | CCGTAGAAGTCCGGGCCGTGTCTCA |
| flavo_8_3 | ATGCCGAAATACGGTACTACGGGGC | roseo_4_3 | GTACCATCTCTGGTAGTAGCACAGG | gamma_15_3 | CGTAGAAGTCCGGGCCGTGTCTCAG |
| flavo_8_4 | TGCCGAAATACGGTACTACGGGGCA | roseo_4_4 | CTGGTAGTAGCACAGGATGTCAAGG | gamma_15_4 | GTAGAAGTCCGGGCCGTGTCTCAGT |
| flavo_8_5 | ACCGTATAACGATGCCGAAATACGG | roseo_4_5 | TGGTAGTAGCACAGGATGTCAAGGG | gamma_15_5 | TTCCGTAGAAGTCCGGGCCGTGTCT |
| flavo_8_6 | CCGTATAACGATGCCGAAATACGGT | roseo_4_6 | GAAGGGACGTACCATCTCTGGTAG | gamma_15_6 | CTTCCGTAGAAGTCCGGGCCGTGTC |
| flavo_8_7 | CGATGCCGAAATACGGTACTACGGG | roseo_4_7 | CCTTAGAGAAGGGCATATTCCCACG | gamma_15_7 | TAGAAGTCCGGGCCGTGTCTCAGTC |
| flavo_8_8 | CCGAAATACGGTACTACGGGGCATT | roseo_4_8 | GGTAGTAGCACAGGATGTCAAGGGT | gamma_15_8 | ACTGCTGCCTTCCGTAGAAGTCCGG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_8_9 | ACGATGCCGAAATACGGTACTACGG | roseo_4_9 | GGGAACGTACCATCTCTGGTAGTAG | gamma_15_9 | CATGCAGTCGAGTTCCAGACTGCAA |
| flavo_8_10 | AACGATGCCGAAATACGGTACTACG | roseo_4_10 | GGAACGTACCATCTCTGGTAGTAGC | gamma_15_10 | CCTCGAGCTATCCCCTCCATTGGG |
| flavo_8_11 | CGAAGGAAAAGTCATCTCTGACCCT | roseo_4_11 | CGAAGGAACGTACCATCTCTGTA | gamma_15_11 | AGAAGTCCGGGCCGTGTCTCAGTCC |
| flavo_8_12 | CGAAATACGGTACTACGGGGCATTA | roseo_4_12 | CCGAAGGAACGTACCATCTCTGGT | gamma_15_12 | TCCTCGAGCTATCCCCTCCATTGG |
| flavo_8_13 | CCGAAGGAAAAGTCATCTCTGACCC | roseo_4_13 | CGTCCCCGAAGGAACGTACCATCT | gamma_15_13 | CTCGAGCTATCCCCTCCATTGGGT |
| flavo_8_14 | GTCATCTCTGACCCTGTCAATATGC | roseo_4_14 | CCCCGAAGGGAACGTACCATCTCTG | gamma_15_14 | TCATGCAGTCGAGTTCCAGACTGCA |
| flavo_8_15 | CCCGAAGGAAAAGTCATCTCTGACC | roseo_4_15 | GTCCCCGAAGGGAACGTACCATCTC | gamma_15_15 | CCTTCCGTAGAAGTCCGGGCCGTGT |
| flavo_8_16 | TACAAGGCAGGTTCCATACGCGGTG | roseo_4_16 | GCGTCCCCGAAGGGAACGTACCATC | gamma_15_16 | GCGCCACTGGATAAATCCAACGGCT |
| flavo_8_17 | GGCTTTAACGGTATAACGATGCCGA | roseo_4_17 | ACTGCGTCCCCGAAGGGAACGTACC | gamma_15_17 | TGCGCCACTGGATAAATCCAACGGC |
| flavo_8_18 | CTGGGCTATTCCCCTGTACAAGGCA | roseo_4_18 | CTGCGTCCCCGAAGGAACGTACCA | gamma_15_18 | TTCCTCGAGCTATCCCCTCCATTG |
| flavo_8_19 | GAAGGAAAAGTCATCTCTGACCCTG | roseo_4_19 | CCCGAAGGAACGTACCATCTCTGG | gamma_15_19 | GTTCCAGACTGCAATTGCAGGACTACG |
| flavo_8_20 | GCCCGAAGGAAAAGTCATCTCTGAC | roseo_4_20 | TGCGTCCCCGAAGGAACGTACCAT | gamma_15_20 | CCAGCTCGCGCTTTGCAACCGTTT |
| flavo_8_21 | GTACAAGGCAGGTTCCATACGCGGT | roseo_4_21 | CTTAGAGAAGGGCATATTCCCACGC | gamma_15_21 | TCGAGCTATCCCCTCCATTGGGTA |
| flavo_8_22 | TGTACAAGGCAGGTTCCATACGCGG | roseo_4_22 | GAAGGGCGCGTCCCGACTTGCATGTA | gamma_15_22 | GCTGCCACTGGATAAATCCAACG |
| flavo_8_23 | CCTGGGCTATTCCCCTGTACAAGGC | roseo_4_23 | CACTGCGTCCCCGAAGGGAACGTAC | gamma_15_23 | CGCCACTGGATAAATCCAACGGCTA |
| flavo_8_24 | ACAAGGCAGGTTCCATACGCGGGTGC | roseo_4_24 | TCACTGCGTCCCCGAAGGGAACGTA | gamma_15_24 | CTGCGCCACTGGATAAATCCAACGG |
| flavo_8_25 | GGCAGGTTCCATACGCGGTGCGCAC | roseo_4_25 | TCCCCGAAGGAACGTACCATCTCT | gamma_15_25 | TTTCCTCGAGCTATCCCCTCCATT |
| flavo_9_1 | ATTCCGCCTACTTCAATACAACTCA | roseo_5_1 | GTCACTATGTCCCGAAGGAAAGCCT | gamma_16_1 | TTTAAGGGTTTGGCTCCAGCTCGCG |
| flavo_9_2 | TTCCGCCTACTTCAATACAACTCAA | roseo_5_2 | CCGAAGGAAAGCCTGATCTCTCAGG | gamma_16_2 | TTTTAAGGGTTTGGCTCCAGCTCGC |
| flavo_9_3 | TATTCCGCCTACTTCAATACAACTC | roseo_5_3 | TGTCACTATGTCCGAAGGAAAGCC | gamma_16_3 | TTAAGGGTTTGGCTCCAGCTCGCGC |
| flavo_9_4 | TCCGCCTACTTCAATACAACTCAAG | roseo_5_4 | TCCGAAGGAAAGCCTGATCTCTCA | gamma_16_4 | GTTTTAAGGGTTTGGCTCCAGCTCG |
| flavo_9_5 | CATATTCCGCCTACTTCAATACAAC | roseo_5_5 | TCACTATGTCCCGAAGGAAAGCCTG | gamma_16_5 | CACGCGGTATACCTGGATCAGGGTT |
| flavo_9_6 | CCGCCTACTTCAATACAACTCAAGA | roseo_5_6 | CCCGAAGGAAAGCCTGATCTCTCAG | gamma_16_6 | ACACGCGGTATACCTGGATCAGGGT |
| flavo_9_7 | CGCCTACTTCAATACAACTCAAGAT | roseo_5_7 | CTGTCACTATGTCCCGAAGGAAAGC | gamma_16_7 | CTTCCTCCGGGTTTCACCCGGCAGT |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_9_8 | GAACTCAAGGTCCCGAACAGCTAGT | roseo_5_8 | GTCCCGAAGGAAAGCCTGATCTCTC | gamma_16_8 | TCCTCCGGGTTTCACCCGGCAGTCT |
| flavo_9_9 | TCAGAACTCAAGGTCCCGAACAGCT | roseo_5_9 | GCCTGATCTCTCAGGTTGTCATAGG | gamma_16_9 | CTTCACACACGCGGTATACCTGGAT |
| flavo_9_10 | ACTCAAGGTCCCGAACAGCTAGTAT | roseo_5_10 | TGACTGACTAATCCGCCTACGTACG | gamma_16_10 | CACACACGCGGTATACCTGGATCAGG |
| flavo_9_11 | GATGCCTATCAATAATACCATGAGG | roseo_5_11 | CTGACTGACTAATCCGCCTACGTAC | gamma_16_11 | ACACACGCGGTATACCTGGATCAGG |
| flavo_9_12 | AGAACTCAAGGTCCCGAACAGCTAG | roseo_5_12 | CGAAGGAAAGCCTGATCTCTCAGGT | gamma_16_12 | CACACACGCGGTATACCTGGATCAG |
| flavo_9_13 | CTCAAGGTCCCGAACAGCTAGTATC | roseo_5_13 | CACTATGTCCCGAAGGAAAGCCTGA | gamma_16_13 | CCTTCCTCCGGGTTTCACCCGGCAG |
| flavo_9_14 | AACTCAAGGTCCCGAACAGCTAGTA | roseo_5_14 | GCACCTGTCACTATGTCCCGAAGGA | gamma_16_14 | TTCCTCCGGGTTTCACCCGGCAGTC |
| flavo_9_15 | CAGAACTCAAGGTCCCGAACAGCTA | roseo_5_15 | CCTGTCACTATGTCCCGAAGGAAAG | gamma_16_15 | CCTCCGGGTTTCACCCGGCAGTCTC |
| flavo_9_16 | CTCAGAACTCAAGGTCCCGAACAGC | roseo_5_16 | CTATGTCCCGAAGGAAAGCCTGATC | gamma_16_16 | TTCACACACGCGGTATACCTGGATC |
| flavo_9_17 | TCAAGGTCCCGAACAGCTAGTATCC | roseo_5_17 | ATGTCCCGAAGGAAAGCCTGATCTC | gamma_16_17 | CGCCTTCCTCCGGGTTTCACCCGGC |
| flavo_9_18 | GCTCAGAACTCAAGGTCCCGAACAG | roseo_5_18 | AGCACCTGTCACTATGTCCCGAAGG | gamma_16_18 | CTCCGGGTTTCACCCGGCAGTCTCC |
| flavo_9_19 | CTACATATTCCGCCTACTTCAATAC | roseo_5_19 | CAGCACCTGTCACTATGTCCCGAAG | gamma_16_19 | GCGGTATACCTGGATCAGGGTTGCC |
| flavo_9_20 | GCCTACTTCAATACAACTCAAGATG | roseo_5_20 | CCTCCGAAGAGGTTAGCGCACCGCC | gamma_16_20 | CGGTATACCTGGATCAGGGTTGCCC |
| flavo_9_21 | TACACGTAAGGCTTATTCTTCCTGT | roseo_5_21 | TCCGCTGCCTCCTCCGAAGAGGTTA | gamma_16_21 | GGTATACCTGGATCAGGGTTGCCCC |
| flavo_9_22 | CACGTAAGGCTTATTCTTCCTGTAT | roseo_5_22 | CCGGCTGCCTCCTCCGAAGAGGTTAG | gamma_16_22 | TCTTCACACACGCGGTATACCTGGA |
| flavo_9_23 | ACACGTAAGGCTTATTCTTCCTGTA | roseo_5_23 | TGTCCCGAAGGAAAGCCTGATCTCT | gamma_16_23 | TCACACACGCGGTATACCTGATCA |
| flavo_9_24 | CTTAGCCGTCAGAACTCAAGGTCC | roseo_5_24 | CACCTGTCACTATGTCCCGAAGGAA | gamma_16_24 | GCCTTCCTCCGGGTTTCACCCGGCA |
| flavo_9_25 | CGCTCAGAACTCAAGGTCCCGAACA | roseo_5_25 | GCAGCACCTGTCACTATGTCCCGAA | gamma_16_25 | CGCGGTATACCTGGATCAGGGTTGC |
| flavo_10_1 | CGCTTAGCCACTCATCTAACCAATG | roseo_6_1 | CGATAAAACCTAGTCTCCTAGGCGG | gamma_17_1 | GGCTCCTCCAATAGTGACCGGTCCG |
| flavo_10_2 | CTTTCGCTTAGCCACTCATCTAACC | roseo_6_2 | CCGAGGCTATTCCGAAGCAAAAGGT | gamma_17_2 | AGGCTCCTCCAATAGTGACCGGTCC |
| flavo_10_3 | ACACGTCGGAGTGTTTCTTCCTGTA | roseo_6_3 | CCCGAGGCTATTCCGAAGCAAAAGG | gamma_17_3 | CAGGCTCCTCCAATAGTGACCGGTC |
| flavo_10_4 | CCCGTGCGCCACTCGTCATCTGGTG | roseo_6_4 | AAAACCTAGTCTCCTAGGCGGTCAG | gamma_17_4 | CATGTATTAGGCCTGCCGCCAACGT |
| flavo_10_5 | ACCCGTGCGCCACTCGTCATCTGGT | roseo_6_5 | AAACCTAGTCTCCTAGGCGGTCAGA | gamma_17_5 | GCTCCTCCAATAGTGACCGGTCCGA |
| flavo_10_6 | CACCCGTGCGCCACTCGTCATCTGG | roseo_6_6 | TCCCGAGGCTATTCCGAAGCAAAAG | gamma_17_6 | GCAGGCTCCTCCAATAGTGACCGGT |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
| --- | --- | --- | --- | --- | --- |
| flavo_10_7 | TACAACCCGTAGGGCTTTCATCCTG | roseo_6_7 | CTAGTCTCCTAGGCGGTCAGAGGAT | gamma_17_7 | CGCCTGAGAGCAAGCTCCCATCGTT |
| flavo_10_8 | ACAACCCGTAGGGCTTTCATCCTGC | roseo_6_8 | AACCTAGTCTCCTAGGCGGTCAGAG | gamma_17_8 | ACGCCTGAGAGCAAGCTCCCATCGT |
| flavo_10_9 | AACCCGTAGGGCTTTCATCCTGCAC | roseo_6_9 | CCTAGTCTCCTAGGCGGTCAGAGGA | gamma_17_9 | GCCTGAGAGCAAGCTCCCATCGTTT |
| flavo_10_10 | CAGTTTACAACCCGTAGGGCTTTCA | roseo_6_10 | TAGTCTCCTAGGCGGTCAGAGGATG | gamma_17_10 | GACGCCTGAGAGCAAGCTCCCATCG |
| flavo_10_11 | CAACCCGTAGGGCTTTCATCCTGCA | roseo_6_11 | CCTCTCAAACCAGCTACTGATCGCA | gamma_17_11 | AATCCTACGCAGGCTCCTCCAATAG |
| flavo_10_12 | TTACAACCCGTAGGGCTTTCATCCT | roseo_6_12 | TCCTCTCAAACCAGCTACTGATCGC | gamma_17_12 | GCATGTATTAGGCCTGCCGCCAACG |
| flavo_10_13 | AGCAGTTTACAACCCGTAGGGCTTT | roseo_6_13 | CTCTCAAACCAGCTACTGATCGCAG | gamma_17_13 | CTAATCCTACGCAGGCTCCTCCAAT |
| flavo_10_14 | GCAGTTTACAACCCGTAGGGCTTTC | roseo_6_14 | CTCAAACCAGCTACTGATCGCAGAC | gamma_17_14 | GCTAATCCTACGCAGGCTCCTCCAA |
| flavo_10_15 | AAGCAGTTTACAACCCGTAGGGCTT | roseo_6_15 | CAGCTACTGATCGCAGACTTGGTAG | gamma_17_15 | CGAGAGCAAGCTCCCATCGTTTCC |
| flavo_10_16 | CACGTTCGGAGTGTTCTTCCTGTAT | roseo_6_16 | CCAGCTACTGATCGCAGACTTGGTA | gamma_17_16 | CCTGAGAGCAAGCTCCCATCGTTTC |
| flavo_10_17 | TGCGCCCACTCGTCATCTGGTGCAA | roseo_6_17 | CCATGCAGCACCTGTCACTCTGTAT | gamma_17_17 | CTCCTCCAATAGTGACCGGTCCGAA |
| flavo_10_18 | CCGTGCGCCACTCGTCATCTGGTGC | roseo_6_18 | CATGCAGCACCTGTCACTCTGTATC | gamma_17_18 | ATCCTACGCAGGCTCCTCCAATAGT |
| flavo_10_19 | GCGCGCCACTCGTCATCTGGTGCAA | roseo_6_19 | AACCAGTACTGATCGCAGACTTGG | gamma_17_19 | CGCAGGCTCCTCCAATAGTGACCGG |
| flavo_10_20 | CGTGCGCCACTCGTCATCTGGTGCA | roseo_6_20 | ACCAGCTACTGATCGCAGACTTGGT | gamma_17_20 | AGCTAATCCTACGCAGGCTCCTCCA |
| flavo_10_21 | GTGCGCCACTCGTCATCTGGTGCAA | roseo_6_21 | GCCATGCAGCACCTGTCACTCTGTA | gamma_17_21 | TCGAGCCCTGAGAGCAAGCTCCCAT |
| flavo_10_22 | GTTTACAACCCGTAGGGCTTTCATC | roseo_6_22 | AGTTTCCCGAGGCTATTCCGAAGCA | gamma_17_22 | CTGAGAGCAAGCTCCCATCGTTTCC |
| flavo_10_23 | TTTACAACCCGTAGGGCTTTCATCC | roseo_6_23 | GTTTCCCGAGGCTATTCCGAAGCAA | gamma_17_23 | TGTATTAGGCCTGCCGCCAACGTTC |
| flavo_10_24 | GCACCCGTGCGCCACTCGTCATCTG | roseo_6_24 | GGCGGTCAGAGGATGTCAAGGGTTG | gamma_17_24 | TGCATGTATTAGGCCTGCCGCCAAC |
| flavo_10_25 | GCGAAGTGGCTGCTCTGTCATCTGGTGCA | roseo_6_25 | AGGCGGTCAGAGGATGTCAAGGGTT | gamma_17_25 | CGCCACCGGTATTCCTCAGAATATC |
| flavo_11_1 | GTACAAGTACTTTATGCTGCCCCTC | alpha_4_1 | CGACAGGACATGCCTGCCACAACTA | gamma_19_1 | GAGGTTGCGACCCTTTGTCTTCCC |
| flavo_11_2 | CCGCCGGAGCTTTTCTTAAAAACTC | alpha_4_2 | CCGACAGGACATGCCTGCCACAACT | gamma_19_2 | GCGAGGTTGCGACCCTTTGTCTTC |
| flavo_11_3 | CGGTCGCCATCAAAGTACAAGTACT | alpha_4_3 | ACCGACAGGACATGCCTGCCACAAC | gamma_19_3 | CGAAACCTTTCAAGAAGAGGGCTCC |
| flavo_11_4 | CCGGTCGCCATCAAAGTACAAGTAC | alpha_4_4 | GACAGGACATGCCTGCCAACAACTAG | gamma_19_4 | AAAGTGGTGAGCGCCCAGATAAGCT |
| flavo_11_5 | CGTCCCTCAGCGTCAGTTAATTGTT | alpha_4_5 | CCGTCTGCCACTATATCGTTCGACT | gamma_19_5 | TGAGCGCCCAGATAAGCTACCCACT |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_11_6 | TACAAGTACTTTATGCTGCCCCTCG | alpha_4_6 | CACCGACAGGCATGCCTGCCAACAA | gamma_19_6 | CAAAGTGGTGAGCGCCCAGATAAGC |
| flavo_11_7 | CACGCGGCATCGCTGGATCAGAGTT | alpha_4_7 | CCCGTCTGCCACTATATCGTTCGAC | gamma_19_7 | GTGGTGAGCGCCCAGATAAGCTACC |
| flavo_11_8 | TCGTCCCTCAGCGTCAGTTAATTGT | alpha_4_8 | CAGGCATGCCTGCCAACAACTAGCT | gamma_19_8 | AGTGGTGAGCGCCCAGATAAGCTAC |
| flavo_11_9 | TCACCGCGGCTCATCGCTGGATCAGAGT | alpha_4_9 | ACAGGCATGCCTGCCAACAACTAGC | gamma_19_9 | GTGAGCGCCCAGATAAGCTACCCAC |
| flavo_11_10 | TGCCAGTATCAAAGGCAGTTCTACC | alpha_4_10 | TCACCGACAGGCATGCCTGCCAACA | gamma_19_10 | GGTGAGCGCCCAGATAAGCTACCCA |
| flavo_11_11 | ACAAGTACTTTATGCTGCCCCTCGA | alpha_4_11 | GCATGCCTGCCAACAACTAGCTCTC | gamma_19_11 | TGGTGAGCGCCCAGATAAGCTACCC |
| flavo_11_12 | GTACATCGAACAGCTAGTGACCATC | alpha_4_12 | GGCATGCCTGCCAACAACTAGCTCT | gamma_19_12 | AAGTGGTGAGCGCCCAGATAAGCTA |
| flavo_11_13 | GCCAGTATCAAAGGCAGTTCTACCG | alpha_4_13 | CACCCGTCTGCCACTATATCGTTCG | gamma_19_13 | CGCCCAGATAAGCTACCCACTTCTT |
| flavo_11_14 | TTCGTCCCTCAGCGTCAGTTAATTG | alpha_4_14 | ACCCGTCTGCCACTATATCGTTCGA | gamma_19_14 | GCGCCCAGATAAGCTACCCACTTCT |
| flavo_11_15 | CAAGTACTTTATGCTGCCCCTCGAC | alpha_4_15 | GTCACCGACAGGCATGCCTGCCAAC | gamma_19_15 | GCGAAACCTTTCAAGAGAGAGGCTC |
| flavo_11_16 | CGCCGGTCGCCATCAAAGTACAAGT | alpha_4_16 | AGGCATGCCTGCCAACAACTAGCTC | gamma_19_16 | AGCGCCCAGATAAGCTACCCACTTC |
| flavo_11_17 | TCGCCGGTCGCCATCAAAGTACAAG | alpha_4_17 | CTCACCCGTCTGCCACTATATCGTT | gamma_19_17 | ACAAAGTGGTGAGCGCCCAGATAAG |
| flavo_11_18 | GCCCGGTCGCCATCAAAGTACAAGTA | alpha_4_18 | TCACCCGTCTGCCACTATATCGTTC | gamma_19_18 | CACAAAGTGGTGAGCGCCCAGATAA |
| flavo_11_19 | TTCGCCGGTCGCCATCAAAGTACAA | alpha_4_19 | CATGCCTGCCAACAACTAGCTCTCA | gamma_19_19 | CGAGGTTGCGACCCTTTGTCCTTCC |
| flavo_11_20 | CGTTCGCCGGTCGCCATCAAAGTAC | alpha_4_20 | CCTGCCAACAACTAGCTCTCATCGT | gamma_19_20 | GAGCGCCCAGATAAGCTACCCACTT |
| flavo_11_21 | GTTCGCCGGTCGCCATCAAAGTACA | alpha_4_21 | CGTCACCGACAGGCATGCCTGCCAA | gamma_19_21 | CGCGAGGTTGCGACCCTTTGTCCTT |
| flavo_11_22 | TACTTATCGGAGCTTAGGTGAGCCG | alpha_4_22 | CTCGGTATTCCGCTAACCTCTCTG | gamma_19_22 | GACGCTAAGAGCAAGCTCTTATCG |
| flavo_11_23 | TATCGGAGCTTAGGTGAGCCGTTAC | alpha_4_23 | ACTCACCCGTCTGCCACTATATCGT | gamma_19_23 | TCACAAAGTGGTGAGCGCCCAGATA |
| flavo_11_24 | CCCTGACTTAACAAACAGCCTGCGG | alpha_4_24 | GCGTCACCGACAGGCATGCCTGCCA | gamma_19_24 | GCAGGCTCATCTGATAGCGAAACCT |
| flavo_11_25 | ACCGTTGAGCGGTAGGATTTCACCC | alpha_4_25 | TACTCACCCGTCTGCCACTATATCG | gamma_19_25 | CGAGCCTAAGGAGCAAGCTCTTATC |
| flavo_12_1 | CGTCTTCCTGCACGCTGCATGGCTG | wolbach_1_1 | GCCAGGACTTCTTCTGTGAGTACCG | gamma_20_1 | CCACTAAGGGACAAATTCCCCAAC |
| flavo_12_2 | CCGTCTTCCTGCACGCTGCATGGCT | wolbach_1_2 | AGCCAGGACTTCTTCTGTGAGTACC | gamma_20_2 | CGCCACTAAGGGACAAATTCCCCA |
| flavo_12_3 | GTCTTCCTGCACGCTGCATGGCTGG | wolbach_1_3 | CCAAGGACTTCTTCTGTGAGTACCGT | gamma_20_3 | GCCACTAAGGGACAAATTCCCCAA |
| flavo_12_4 | CTTCCTGCACGCTGCATGGCTGGAT | wolbach_1_4 | CGGAGTTAGCACCAGGACTTCTTCTGT | gamma_20_4 | CACTAAGGGACAAATTCCCCAACG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_12_5 | TTCCTGCACGCTGCATGGCTGGATC | wolbach_1_5 | CCGGCCGAACCGACCCTATCCCTTC | gamma_20_5 | ACTAAGGGACAAATTCCCCCAACGG |
| flavo_12_6 | GCCGTCTTCCTGCACGCTGCATGGC | wolbach_1_6 | ACGGAGTTAGCCAGGACTTCTTCTG | gamma_20_6 | CTAAGGGACAAATTCCCCCAACGGC |
| flavo_12_7 | TCTTCCTGCACGCTGCATGGCrGGA | wolbach_1_7 | GGAGTTAGCCAGGACTTCTTCTGTG | gamma_20_7 | GCGCCACTAAGGGACAAATTCCCCC |
| flavo_12_8 | CACGCTGCATGGCTGGATCAGAGTT | wolbach_1_8 | CAGGACTTCTTCTGTGAGTACCGTC | gamma_20_8 | GGTACCGTCAAGACGCGCAGTTATT |
| flavo_12_9 | GGCCGTCTTCCTGCACGCTGCATGG | wolbach_1_9 | GGCACGGAGTTAGCCAGGACTTCTT | gamma_20_9 | AGGTACCGTCAAGACGCGCAGTTAT |
| flavo_12_10 | TGCCCACCTTTTACCACCGGAGTTT | wolbach_1_10 | CACGGAGTTAGCCAGGACTTCTTCT | gamma_20_10 | TAGGTACCGTCAAGACGCGCAGTTA |
| flavo_12_11 | ATGCCCACCTTTTACCACCGGAGTT | wolbach_1_11 | TGGCACGGAGTTAGCCAGGACTTCT | gamma_20_11 | TGCGCCACTAAGGGACAAATTCCCC |
| flavo_12_12 | CACACGTGGACAGATTTCTTCCTGT | wolbach_1_12 | GCACGGAGTTAGCCAGGACTTCTTC | gamma_20_12 | TAAGGGACAAATTCCCCCAACGGCT |
| flavo_12_13 | GAAGACTCGCTCTTCCTCGCGGAGT | wolbach_1_13 | CGCCTCAGCGTCAGATTTGAACCAG | gamma_20_13 | CTGTAGGTACCGTCAAGACGCGCAG |
| flavo_12_14 | CATGCCCACCTTTTACCACCGGAGT | wolbach_1_14 | GCGCCTCAGCGTCAGATTTGAACCA | gamma_20_14 | GTAGGTACCGTCAAGACGCGCAGTT |
| flavo_12_15 | CCGGCTTTGAAGACTCGCTCTTCCT | wolbach_1_15 | CTGGCACGGAGTTAGCCAGGACTTC | gamma_20_15 | CTGCGCCACTAAGGGACAAATTCCC |
| flavo_12_16 | CCACACGTGGACAGATTTCTTCCTG | wolbach_1_16 | CTGCTGGCACGGAGTTAGCCAGGAC | gamma_20_16 | TGTAGGTACCGTCAAGACGCGCAGT |
| flavo_12_17 | TTTGAAGACTCGCTCTTCCTCGCGG | wolbach_1_17 | GTTGGCACGGAGTTAGCCAGGACTT | gamma_20_17 | TCTGTAGGTACCGTCAAGACGCGCA |
| flavo_12_18 | GGCTTTGAAGACTCGCTCTTCCTCG | wolbach_1_18 | TGCTGGCACGGAGTTAGCCAGGACT | gamma_20_18 | GCTGCCCACTAAGGGACAAATTCC |
| flavo_12_19 | CTTTGAAGACTCGCTCTTCCTCGCG | wolbach_1_19 | CCCGCCTCAGCGTCAGATTTGAACC | gamma_20_19 | CTTCTGTAGGTACCGTCAAGACGCG |
| flavo_12_20 | TGAAGACTCGCTCTTCCTCGCGGAG | wolbach_1_20 | GCCTTCGCGCCTCAGCGTCAGATTT | gamma_20_20 | TCTTCTGTAGGTACCGTCAAGACGC |
| flavo_12_21 | GACCGGCTTTGAAGACTCGCTCTTC | wolbach_1_21 | GCCTCAGCGTCAGATTTGAACCAGA | gamma_20_21 | GGACAAATTCCCCCAACGGCTAGTT |
| flavo_12_22 | CGGCTTTGAAGACTCGCTCTTCCTC | wolbach_1_22 | TCGCGCCTCAGCGTCAGATTTGAAC | gamma_20_22 | GACAAATTCCCCCAACGGCTAGTTG |
| flavo_12_23 | GCTTTGAAGACTCGCTCTTCCTCGC | wolbach_1_23 | CATGCAACACCTGTGTGAAACCCGG | gamma_20_23 | AGCTGCGCCACTAAGGGACAAATTC |
| flavo_12_24 | ACCGGCTTTGAAGACTCGCTCTTCC | wolbach_1_24 | GACTTTGCAGCCCATTGTAGCCACC | gamma_20_24 | CGTTACGCACCCGTCCGCCACTCGA |
| flavo_12_25 | TCGTACAGTACCGTCAACTACCCAC | wolbach_1_25 | CGACTTTGCAGCCCATTGTAGCCAC | gamma_20_25 | TCGCGTTAGCTGCGCCACTAAGGGA |
| flavo_13_1 | CGCCGGTCGTCAGCATAGCAAGCTA | rickett_1_1 | TCTCTGCGATCCGCGACCACCATGT | gamma_21_1 | TCGTCAGCGCGAGAGCAAGCTCCGC |
| flavo_13_2 | AGGTCGCTCCTCACGGTAACGAACT | rickett_1_2 | AtCTCTGCGATCCGCGACCACCATG | gamma_21_2 | CTCGTCAGCGCCAGAGCAAGCTCCG |
| flavo_13_3 | GGTGCTCCTCACGGTAACGAACTT | rickett_1_3 | GTCAGTTGTAGCCCAGATGACCGCC | gamma_21_3 | ACTCGTCAGCGCCAGAGCAAGCTCCG |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_13_4 | TAGGTCGCTCCTCACGGTAACGAAC | rickett_1_4 | CAGTTGTAGCCCAGATGACCGCTT | gamma_21_4 | AGCAAGCTCCGCCTGTTACCGTTCG |
| flavo_13_5 | AGGACGCATAGTCATCTTGTACCCA | rickett_1_5 | TCAGTTGTAGCCCAGATGACCGCCT | gamma_21_5 | GTCAGCGCAGAGCAAGCTCCGCCTG |
| flavo_13_6 | CCTCACGGTAACGAACTTCAGGCAC | rickett_1_6 | CGTCAGTTGTAGCCCAGATGACCGC | gamma_21_6 | GAGCAAGCTCCGCCTGTTACCGTTC |
| flavo_13_7 | TCGCCCAGTGGCTGCTCATTGTCCA | rickett_1_7 | GTTGTAGCCCAGATGACCGCCTTCG | gamma_21_7 | CAAGCTCCGCCTGTTACCGTTCGAC |
| flavo_13_8 | CGTTCGCCGTCGTCAGCATAGCAA | rickett_1_8 | AGTTGTAGCCCAGATGACCGCCTTC | gamma_21_8 | GCTCCGCCTGTTACCGTTCGACTTG |
| flavo_13_9 | GTCGCTCCTCACGGTAACGAACTTC | rickett_1_9 | CATCTCTGCGATCCGCGACCACCAT | gamma_21_9 | CTGGGCTTTCACATCCGACTGACCG |
| flavo_13_10 | GTCGCCCAGTGGCTGCTCATTGTCC | rickett_1_10 | GCGTCAGTTGTAGCCCAGATGACCG | gamma_21_10 | CTTTTGCAAGCCACTCCCATGGTGT |
| flavo_13_11 | TAGGACGCATAGTCATCTTGTACCC | rickett_1_11 | AGCATCTCTGCGATCCGCGACCACC | gamma_21_11 | TCTTTTGCAAGCCACTCCCATGGTG |
| flavo_13_12 | ACCAGTATCAAAGGCAGTTCCATCG | rickett_1_12 | GCATCTCTGCGATCCGCGACCACCA | gamma_21_12 | CTTCTTTTGCAAGCCACTCCCATGG |
| flavo_13_13 | TCCTCACGGTAACGAACTTCAGGCA | rickett_1_13 | TTGTAGCCCAGATGACCGCCTTCG | gamma_21_13 | TTTTGCAAGCCACTCCCATGGTGTG |
| flavo_13_14 | CTAGTTCGCTCCTCACGGTAACGAA | rickett_1_14 | AGCGTCAGTTGTAGCCCAGATGACC | gamma_21_14 | TTTGCAAGCCACTCCCATGGTGTGA |
| flavo_13_15 | CTCCTCACGGTAACGAACTTCAGGC | rickett_1_15 | CCACTAACTAATTGGAGCAAGCCCC | gamma_21_15 | CCTCAGCGTCAGTATTGCTCCAGAA |
| flavo_13_16 | CCGTTCGCCGGTCGTCAGCATAGCA | rickett_1_16 | GCCACTAACTAATTGGAGCAAGCCC | gamma_21_16 | GGGGCTTTCACATCCGACTGACCGTG |
| flavo_13_17 | GTTCGCCGGTCGTCAGCATAGCAAG | rickett_1_17 | CAAGCCCCAATTAGTCCGTTCGACT | gamma_21_17 | CTTTCACATCCGACTGACCGTGCCG |
| flavo_13_18 | CTCACGGTAACGAACTTCAGGCACT | rickett_1_18 | CCGTTCTGCTTCCCTCTGTAAACAC | gamma_21_18 | GGCTTTCACATCCGACTGACCGTGC |
| flavo_13_19 | TCGCTCCTCACGGTAACGAACTTCA | rickett_1_19 | CCGTCTGCCACTAACTAATTGGAGC | gamma_21_19 | CACTCGTCAGCGCAGAGCAAGCTCC |
| flavo_13_20 | GGTCGCCCAGTGGCTGCTCATTGTC | rickett_1_20 | CTCTGCGATCCGCGACCACCATGTC | gamma_21_20 | GCTTTCACATCCGACTGACCGTGCC |
| flavo_13_21 | CGGCATAGTGGTTCAGAGTTGCCT | rickett_1_21 | GCAAGCCCCAATTAGTCCGTTCGAC | gamma_21_21 | TCAGCGCAGAGCAAGCTCCGCCTGT |
| flavo_13_22 | GGCATAGTGGTTCAGAGTTGCCTC | rickett_1_22 | AGCAAGCCCCAATTAGTCCGTTCGA | gamma_21_22 | CGTCAGCGCAGAGCAAGCTCCGCCT |
| flavo_13_23 | CGCGGCATAGTGGTTCAGAGTTGC | rickett_1_23 | TGTAGCCCAGATGACCGCCTTCGCC | gamma_21_23 | AGAGCAAGCTCCGCCTGTTACCGTT |
| flavo_13_24 | GCGGCATAGTGGTTCAGAGTTGCC | rickett_1_24 | GAGCAAGCCCCAATTAGTCCGTTCG | gamma_21_24 | AGCTCCGCCTGTTACCGTTCGACTT |
| flavo_13_25 | GCATAGTGGTTCAGAGTTGCCTCC | rickett_1_25 | GAAGAAAAGCCATCTCTGCGATCCGC | gamma_21_25 | CAGAGCAAGCTCCGCCTGTTACCGT |
| flavo_14_1 | GTGCAAGCACTCCTGTTACCCCCTCG | alpha_5_1 | ACCAAAGCCCTGTGGGCCCTAGCAG | verru_1_1 | CCCGAGATTTCACACCTCACACAT |
| flavo_14_2 | AGTGCAAGCACTCCTGTTACCCCTC | alpha_5_2 | CACCAAAGCCCTGTGGGCCCTAGCA | verru_1_2 | CCCGAGATTTCACACCTCACACATC |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_14_3 | GCAAGCACTCCTGTTACCCCTCGAC | alpha_5_3 | CCAAAGCCCTGTGGGCCCTAGCAGC | verru_1_3 | TCACACCTCACACATCTATCCGCCT |
| flavo_14_4 | TGCAAGCACTCCTGTTACCCCTCGA | alpha_5_4 | ACCCTATGGTAGATCCCCACGCGTT | verru_1_4 | CACCCTCACACATCTATCCGCTACG |
| flavo_14_5 | CAAGCACTCCTGTTACCCCTTCGACT | alpha_5_5 | CACCCTATGGTAGATCCCCACGCGT | verru_1_5 | TTCACACCTCACACATCTATCCGCC |
| flavo_14_6 | AAGCACTCCTGTTACCCCTCGACTT | alpha_5_6 | GCACCCTATGGTAGATCCCCACGCG | verru_1_6 | ACACCTCACACATCTATCCGCCTAC |
| flavo_14_7 | AGCACTCCTGTTACCCCTCGACTTG | alpha_5_7 | CCGCACCCTATGGTAGATCCCCACG | verru_1_7 | CACACCTCACACATCTATCCGCCTA |
| flavo_14_8 | GCACTCCTGTTACCCCTCGACTTGC | alpha_5_8 | CGCACCCTATGGTAGATCCCCACGC | verru_1_8 | GCCCCGAGATTTCACACCTCACACA |
| flavo_14_9 | TGCTACACGTAGCAGTGTTTCTTCC | alpha_5_9 | TATTCCGCACCCTATGGTAGATCCC | verru_1_9 | ACCTCACACATCTATCCGCCTACGC |
| flavo_14_10 | CCCGTGCGCCGGTCGTCAGCGAGTG | alpha_5_10 | ATTCCGCACCCTATGGTAGATCCCC | verru_1_10 | AGCCCCGAGATTTCACACCTCACAC |
| flavo_14_11 | TCGTCAGCGAGTGCAAGCACTCCTG | alpha_5_11 | TCCGCACCCTATGGTAGATCCCCAC | verru_1_11 | CTCCCGAAGGATAGCTCACGTACTT |
| flavo_14_12 | TGCGCCGGTCGTCAGCGAGTGCAAG | alpha_5_12 | CGCACCAGCTTCGGGTTGATCCAAC | verru_1_12 | CTGCCTCCCGAAGGATAGCTCACGT |
| flavo_14_13 | CGGTCGTCAGCGAGTGCAAGCACTC | alpha_5_13 | TTCCGCACCCTATGGTAGATCCCCA | verru_1_13 | GGCTATGAACCTCCTTGTTGCTCCT |
| flavo_14_14 | CCGTGCGCCGGTCGTCAGCGAGTGC | alpha_5_14 | CCACCAAAGCCCTGTGGGCCCTAGC | verru_1_14 | CCTCCCGAAGGATAGCTCACGTACT |
| flavo_14_15 | GCGCCGGTCGTCAGCGAGTGCAAGC | alpha_5_15 | CCCTATGGTAGATCCCCACGCGTTA | verru_1_15 | CCCGAAGGATAGCTCACGTACTTCG |
| flavo_14_16 | GGTCGTCAGCGAGTGCAAGCACTCC | alpha_5_16 | CCTATGGTAGATCCCCACGCGTTAC | verru_1_16 | TCCCGAAGGATAGCTCACGTACTTC |
| flavo_14_17 | GCCGGTCGTCAGCGAGTGCAAGCAC | alpha_5_17 | GCGCACCAGCTTCGGGTTGATCCAA | verru_1_17 | GAGGGTATGAACCTCCTTGTTGCTC |
| flavo_14_18 | GTCAGCGAGTGCAAGCACTCCTGTT | alpha_5_18 | GCACCAGCTTCGGGTTGATCCAACT | verru_1_18 | GACGCTGCCTCCCGAAGGATAGCTC |
| flavo_14_19 | CCGGTCGTCAGCGAGTGCAAGCACT | alpha_5_19 | AGCGCACCAGCTTCGGGTTGATCCA | verru_1_19 | AGGCTATGAACCTCCTTGTTGCTCC |
| flavo_14_20 | TCAGCGAGTGCAAGCACTCCTGTTA | alpha_5_20 | CTATGGTAGATCCCCACGCGTTACG | verru_1_20 | GCCTCCCGAAGGATAGCTCACGTAC |
| flavo_14_21 | CGTGCGCCGGTCGTCAGCGAGTGCA | alpha_5_21 | GCCACCAAAGCCCTGTGGGCCCTAG | verru_1_21 | CGCTGCCTCCCGAAGGATAGCTCAC |
| flavo_14_22 | CGCCGGTCGTCAGCGAGTGCAAGCA | alpha_5_22 | CACCAGCTTCGGGTTGATCCAACTC | verru_1_22 | TGCCTCCCGAAGGATAGCTCACGTA |
| flavo_14_23 | GTGCCGGTCGTCAGCGAGTGCAAGC | alpha_5_23 | TAGCGCACCAGCTTCGGGTTGATCC | verru_1_23 | ACGCTGCCTCCCGAAGGATAGCTCA |
| flavo_14_24 | CGTCAGCGAGTGCAAGCACTCCTGT | alpha_5_24 | CAAAGCCCTGTGGGCCCTAGCAGCT | verru_1_24 | GCTGCCTCCCGAAGGATAGCTCACG |
| flavo_14_25 | GTCGTCAGCGAGTGCAAGCACTCCT | alpha_5_25 | CGCCACCAAAGCCCTGTGGGCCCTA | verru_1_25 | AGGACGCTGCCTCCCGAAGGATAGC |
| flavo_15_1 | GGCGTACTCCCCAGTGCATCACTT | alpha_6_1 | GCGCCACTAACCCGAAGCTTCGTT | verru_2_1 | CGTCGCATGTTCACACTTTCGTGCA |

TABLE 1-continued list of probes specific for laboratory bacterial strains
and San Francisco Bay natural community

| SEQUENCE_ID | PROBE_SEQUENCE | SEQUENCE_ID | PROBE_SEQUENCE | SEQUENCE_ID | PROBE_SEQUENCE |
|---|---|---|---|---|---|
| flavo_15_2 | CTCCCCAGGTGCATCACTTAATACT | alpha_6_2 | CTTCTTGCGAGTAGCTGCCCACTGT | verru_2_2 | CTACCCTAACTTTCGTCCATGAGCG |
| flavo_15_3 | GCGTACTCCCCAGGTGCATCACTTA | alpha_6_3 | CCCAGCTTGTTGGGCCATGAGGACT | verru_2_3 | ACCCTAACTTTCGTCCATGAGCGTC |
| flavo_15_4 | CGGGCTACTCCCCAGGTGCATCACT | alpha_6_4 | ATCTTCTTGCGAGTAGCTGCCCACT | verru_2_4 | GCGTCGCATGTTCACACTTTCGTGC |
| flavo_15_5 | ACTCCCCAGGTGCATCACTTAATAC | alpha_6_5 | TCTTCTTGCGAGTAGCTGCCCACTG | verru_2_5 | CAAGTGTTCCCTTCTCCCCTTCCAGT |
| flavo_15_6 | CGTACTCCCCAGGTGCATCACTTAA | alpha_6_6 | TAGCCCCAGCTTGTTGGGCCATGAGG | verru_2_6 | TACACCAAGTGTTCCCTTCTCCCCT |
| flavo_15_7 | CCGGCGTACTCCCCAGGTGCATCAC | alpha_6_7 | GCCACTAACCCCGAAGCTTCGTTCG | verru_2_7 | CCAAGTGTTCCCTTCTCCCCTCCAG |
| flavo_15_8 | GTACTCCCCAGGTGCATCACTTAAT | alpha_6_8 | GTAGCCCAGCTTGTTGGGCCATGAG | verru_2_8 | ACACCAAGTGTTCCCTTCTCCCCTC |
| flavo_15_9 | GCCGGCGTACTCCCCAGGTGCATCA | alpha_6_9 | CGCCACTAACCCCGAAGCTTCGTTC | verru_2_9 | CGCTACACCAAGTGTTCCCTTCTCC |
| flavo_15_10 | GAAGAGAAGGCCTGTTTCCAAGCCG | alpha_6_10 | TTCTTGCGAGTAGCTGCCCACTGTC | verru_2_10 | CACCAAGTGTTCCCTTCTCCCCTCC |
| flavo_15_11 | CAACAGCGAGTGATGATCGTTTACG | alpha_6_11 | TAGCATCTTCTTGCGAGTAGCTGCC | verru_2_11 | GCTACACCAAGTGTTCCCTTCTCCC |
| flavo_15_12 | GCATGCCCATCTCATACCGAAAAAC | alpha_6_12 | AGCATCTTCTTGCGAGTAGCTGCCC | verru_2_12 | CTACACCAAGTGTTCCCTTCTCCCC |
| flavo_15_13 | TTGTAATCTGCTCCGAAGAGAAGGC | alpha_6_13 | GCCCAGCTTGTTGGGCCATGAGGAC | verru_2_13 | AGTGTTCCCTTCTCCCCTCCAGTAC |
| flavo_15_14 | CGCCGGTCGTCAGCAAAAGCAAGCT | alpha_6_14 | CACTAACCCCGAAGCTTCGTTCGAC | verru_2_14 | AAGTGTTCCCTTCTCCCCTCCAGTA |
| flavo_15_15 | AAGAGAAGGCCTGTTTCCAAGCCGG | alpha_6_15 | CATCTTCTTGCGAGTAGCTGCCCAC | verru_2_15 | ACCAAGTGTTCCCTTCTCCCCTCCA |
| flavo_15_16 | GCCGGTCGTCAGCAAAAGCAAGCTT | alpha_6_16 | TGTAGCCCAGCTTGTTGGGCCATGA | verru_2_16 | GCTACCCTAACTTTCGTCCATGAGC |
| flavo_15_17 | TGCCGGTCGTCAGCAAAAGCAAGCTGCATC | alpha_6_17 | AGCCCAGCTTGTTGGGCCATGAGGA | verru_2_17 | GTTCCCTTCTCCCCTCCAGTACTCT |
| flavo_15_18 | GCGCCGGTCGTCAGCAAAAGCAAGC | alpha_6_18 | CCACTAACCCCGAAGCTTCGTTCGA | verru_2_18 | GTGTTCCCTTCTCCCCTCCAGTACT |
| flavo_15_19 | CGAAGAGAAGGCCTGTTTCCAAGCC | alpha_6_19 | GCATCTTCTTGCGAGTAGCTGCCCA | verru_2_19 | TGTTCCCTTCTCCCCTCCAGTACTC |
| flavo_15_20 | CCAACAGCGAGTGATGATCGTTTAC | alpha_6_20 | GTGTAGCCCAGCTTGTTGGGCCATG | verru_2_20 | CCGTACACCAAGTGTTCCCTTCTC |
| flavo_15_21 | GGAGTATTAATCCCCGTTTCCAGGG | alpha_6_21 | TGCGCCACTAACCCCGAAGCTTCGT | verru_2_21 | TTCCCTTCTCCCCTCCAGTACTCTA |
| flavo_15_22 | TGGAGTATTAATCCCCGTTTCCAGG | alpha_6_22 | CTCAAGACCAAGTGCCGAACAGC | verru_2_22 | GGCGTCGCATGTTCACACTTTCGTG |
| flavo_15_23 | TCCCCGTTTCCAGGGGCTATCCTCC | alpha_6_23 | CCAGCTTGTTGGGCCATGAGGACTT | verru_2_23 | CGCTACCCTAACTTTCGTCCATGAG |
| flavo_15_24 | TGCGCCGGTCGTCAGCAAAAGCAAG | alpha_6_24 | ACTAACCCCGAAGCTTCGTTCGACT | verru_2_24 | CCCTAACTTTCGTCCATGAGCGTCA |
| flavo_15_25 | AACAGCGAGTGATGATCGTTTACGG | alpha_6_25 | TCTTGCGAGTAGCTGCCCACTGTCA | verru_2_25 | ACCGTACACCAAGTGTTCCCTTCT |

SEQUENCE LISTING (2805 sequences)

SEQ ID NO: 1 - DNA, 25 bp, Artificial Sequence
  Corresponding array ID: Pstutzeri_1
taaccgtccccccgaaggttagact

SEQ ID NO: 2 - DNA, 25 bp, Artificial Sequence
  Corresponding array ID: Pstutzeri_2
ggtaaccgtccccccgaaggttaga

SEQ ID NO: 3 - DNA, 25 bp, Artificial Sequence
  Corresponding array ID: Pstutzeri_3
tggtaaccgtccccccgaaggttag

SEQ ID NO: 4 - DNA, 25 bp, Artificial Sequence
  Corresponding array ID: Pstutzeri_4
gtaaccgtccccccgaaggttagac

SEQ ID NO: 5 - DNA, 25 bp, Artificial Sequence
  Corresponding array ID: Pstutzeri_5
actccgtggtaaccgtccccccgaa

SEQ ID NO: 6 - DNA, 25 bp, Artificial Sequence
  Corresponding array ID: Pstutzeri_6
cactccgtggtaaccgtccccccga

SEQ ID NO: 7 - DNA, 25 bp, Artificial Sequence
  Corresponding array ID: Pstutzeri_7
tcactccgtggtaaccgtccccccg

SEQ ID NO: 8 - DNA, 25 bp, Artificial Sequence
  Corresponding array ID: Pstutzeri_8
accgtccccccgaaggttagactag

SEQ ID NO: 9 - DNA, 25 bp, Artificial Sequence
  Corresponding array ID: Pstutzeri_9
atcactccgtggtaaccgtcccccc

SEQ ID NO: 10 - DNA, 25 bp, Artificial Sequence
  Corresponding array ID: Pstutzeri_10
ccgtggtaaccgtccccccgaaggt

SEQ ID NO: 11 - DNA, 25 bp, Artificial Sequence
  Corresponding array ID: Pstutzeri_11
ctccgtggtaaccgtccccccgaag

SEQ ID NO: 12 - DNA, 25 bp, Artificial Sequence
  Corresponding array ID: Pstutzeri_12
ccgtccccccgaaggttagactagc

SEQ ID NO: 13 - DNA, 25 bp, Artificial Sequence
  Corresponding array ID: Pstutzeri_13
ccaccaccctctgccatactctagc

SEQ ID NO: 14 - DNA, 25 bp, Artificial Sequence
  Corresponding array ID: Pstutzeri_14
tccaccaccctctgccatactctag

SEQ ID NO: 15 - DNA, 25 bp, Artificial Sequence
  Corresponding array ID: Pstutzeri_15
ttccaccaccctctgccatactcta

SEQ ID NO: 16 - DNA, 25 bp, Artificial Sequence
  Corresponding array ID: Pstutzeri_16
aattccaccaccctctgccatactc

SEQ ID NO: 17 - DNA, 25 bp, Artificial Sequence
  Corresponding array ID: Pstutzeri_17
aaattccaccaccctctgccatact

SEQ ID NO: 18 - DNA, 25 bp, Artificial Sequence
  Corresponding array ID: Pstutzeri_18
gaaattccaccaccctctgccatac

SEQ ID NO: 19 - DNA, 25 bp, Artificial Sequence
  Corresponding array ID: Pstutzeri_19
attccaccaccctctgccatactct

SEQ ID NO: 20 - DNA, 25 bp, Artificial Sequence
  Corresponding array ID: Pstutzeri_20
ggaaattccaccaccctctgccata

SEQ ID NO: 21 - DNA, 25 bp, Artificial Sequence
  Corresponding array ID: Pstutzeri_21
caggaaattccaccaccctctgcca

SEQ ID NO: 22 - DNA, 25 bp, Artificial Sequence
  Corresponding array ID: Pstutzeri_22
aggaaattccaccaccctctgccat

SEQ ID NO: 23 - DNA, 25 bp, Artificial Sequence
  Corresponding array ID: Pstutzeri_23
cagtgtcagtattagcccaggtggt

SEQ ID NO: 24 - DNA, 25 bp, Artificial Sequence
  Corresponding array ID: Pstutzeri_24
tcagtattagcccaggtggtcgcct

SEQ ID NO: 25 - DNA, 25 bp, Artificial Sequence
  Corresponding array ID: Pstutzeri_25
tcagtgtcagtattagcccaggtgg

SEQ ID NO: 26 - DNA, 25 bp, Artificial Sequence
  Corresponding array ID: Pstutzeri_26
tgtcagtattagcccaggtggtcgc

SEQ ID NO: 27 - DNA, 25 bp, Artificial Sequence
  Corresponding array ID: Pstutzeri_27
gtcagtattagcccaggtggtcgcc

SEQ ID NO: 28 - DNA, 25 bp, Artificial Sequence
  Corresponding array ID: Pstutzeri_28
cctcagtgtcagtattagcccaggt

SEQ ID NO: 29 - DNA, 25 bp, Artificial Sequence
  Corresponding array ID: Pstutzeri_29
ctcagtgtcagtattagcccaggtg

SEQ ID NO: 30 - DNA, 25 bp, Artificial Sequence
  Corresponding array ID: Pstutzeri_30
acctcagtgtcagtattagcccagg

SEQ ID NO: 31 - DNA, 25 bp, Artificial Sequence
  Corresponding array ID: Pstutzeri_31
gtgtcagtattagcccaggtggtcg

SEQ ID NO: 32 - DNA, 25 bp, Artificial Sequence
  Corresponding array ID: Pstutzeri_32
agtgtcagtattagcccaggtggtc

SEQ ID NO: 33 - DNA, 25 bp, Artificial Sequence
  Corresponding array ID: Pstutzeri_33
cacctcagtgtcagtattagcccag

SEQ ID NO: 34 - DNA, 25 bp, Artificial Sequence
  Corresponding array ID: Pstutzeri_34
gcacctcagtgtcagtattagccca

SEQ ID NO: 35 - DNA, 25 bp, Artificial Sequence
  Corresponding array ID: Pstutzeri_35
cgcacctcagtgtcagtattagccc

SEQ ID NO: 36 - DNA, 25 bp, Artificial Sequence
  Corresponding array ID: Pstutzeri_36
ttcgcacctcagtgtcagtattagc

SEQ ID NO: 37 - DNA, 25 bp, Artificial Sequence
  Corresponding array ID: Pstutzeri_37
tcgcacctcagtgtcagtattagcc

SEQ ID NO: 38 - DNA, 25 bp, Artificial Sequence
  Corresponding array ID: Pstutzeri_38
aatgcgttagctgcgccactaagat

SEQ ID NO: 39 - DNA, 25 bp, Artificial Sequence
  Corresponding array ID: Pstutzeri_39
caccaccctctgccatactctagct

SEQ ID NO: 40 - DNA, 25 bp, Artificial Sequence
  Corresponding array ID: Pstutzeri_40
acacaggaaattccaccaccctctg

SEQ ID NO: 41 - DNA, 25 bp, Artificial Sequence
  Corresponding array ID: Pstutzeri_41
cacaggaaattccaccaccctctgc

SEQ ID NO: 42 - DNA, 25 bp, Artificial Sequence
  Corresponding array ID: Pstutzeri_42
acaggaaattccaccaccctctgcc

SEQ ID NO: 43 - DNA, 25 bp, Artificial Sequence
  Corresponding array ID: Pstutzeri_43
gaagttagccggtgcttattctgtc

SEQ ID NO: 44 - DNA, 25 bp, Artificial Sequence
  Corresponding array ID: Pstutzeri_44
gaaagttctctgcatgtcaaggcct

SEQ ID NO: 45 - DNA, 25 bp, Artificial Sequence
  Corresponding array ID: Pstutzeri_45
aaagttctctgcatgtcaaggcctg

SEQ ID NO: 46 - DNA, 25 bp, Artificial Sequence
  Corresponding array ID: Pstutzeri_46
tctctgcatgtcaaggcctggtaag

SEQ ID NO: 47 - DNA, 25 bp, Artificial Sequence
  Corresponding array ID: Pstutzeri_47
gttctctgcatgtcaaggcctggta

SEQ ID NO: 48 - DNA, 25 bp, Artificial Sequence
  Corresponding array ID: Pstutzeri_48
agttctctgcatgtcaaggcctggt

SEQ ID NO: 49 - DNA, 25 bp, Artificial Sequence
  Corresponding array ID: Pstutzeri_49
aagttctctgcatgtcaaggcctgg

SEQ ID NO: 50 - DNA, 25 bp, Artificial Sequence
  Corresponding array ID: Pstutzeri_50
ctctgcatgtcaaggcctggtaagg

SEQ ID NO: 51 - DNA, 25 bp, Artificial Sequence
  Corresponding array ID: Pstutzeri_51
ttctctgcatgtcaaggcctggtaa

SEQ ID NO: 52 - DNA, 25 bp, Artificial Sequence
  Corresponding array ID: Pstutzeri_52
ctgcatgtcaaggcctggtaaggtt

SEQ ID NO: 53 - DNA, 25 bp, Artificial Sequence
  Corresponding array ID: Pstutzeri_53
tctgcatgtcaaggcctggtaaggt

SEQ ID NO: 54 - DNA, 25 bp, Artificial Sequence
  Corresponding array ID: Pstutzeri_54
tactcacccgtccgccgctgaatca

SEQ ID NO: 55 - DNA, 25 bp, Artificial Sequence
  Corresponding array ID: Pstutzeri_55
cagccatgcagcacctgtgtcagag

SEQ ID NO: 56 - DNA, 25 bp, Artificial Sequence
  Corresponding array ID: Pstutzeri_56
acagccatgcagcacctgtgtcaga

SEQ ID NO: 57 - DNA, 25 bp, Artificial Sequence
  Corresponding array ID: Pstutzeri_57
gacagccatgcagcacctgtgtcag

SEQ ID NO: 58 - DNA, 25 bp, Artificial Sequence
  Corresponding array ID: Pstutzeri_58
ctggaaagttctctgcatgtcaagg

SEQ ID NO: 59 - DNA, 25 bp, Artificial Sequence
  Corresponding array ID: Pstutzeri_59
tggaaagttctctgcatgtcaaggc

SEQ ID NO: 60 - DNA, 25 bp, Artificial Sequence
  Corresponding array ID: Pstutzeri_60
ggaaagttctctgcatgtcaaggcc

SEQ ID NO: 61 - DNA, 25 bp, Artificial Sequence
  Corresponding array ID: eukaryotes_1
aactaagaacggccatgcaccacca

SEQ ID NO: 62 - DNA, 25 bp, Artificial Sequence
  Corresponding array ID: eukaryotes_2
caccaactaagaacggccatgcacc

SEQ ID NO: 63 - DNA, 25 bp, Artificial Sequence
  Corresponding array ID: eukaryotes_3
ccaactaagaacggccatgcaccac

SEQ ID NO: 64 - DNA, 25 bp, Artificial Sequence
  Corresponding array ID: eukaryotes_4
accaactaagaacggccatgcacca

SEQ ID NO: 65 - DNA, 25 bp, Artificial Sequence
  Corresponding array ID: eukaryotes_5
ccaccaactaagaacggccatgcac

SEQ ID NO: 66 - DNA, 25 bp, Artificial Sequence
  Corresponding array ID: eukaryotes_6
tccaccaactaagaacggccatgca

SEQ ID NO: 67 - DNA, 25 bp, Artificial Sequence
  Corresponding array ID: eukaryotes_7
caactaagaacggccatgcaccacc

SEQ ID NO: 68 - DNA, 25 bp, Artificial Sequence
  Corresponding array ID: eukaryotes_8
ctccaccaactaagaacggccatgc

SEQ ID NO: 69 - DNA, 25 bp, Artificial Sequence
  Corresponding array ID: eukaryotes_9
ttggagctggaattaccgcggctgc

SEQ ID NO: 70 - DNA, 25 bp, Artificial Sequence
  Corresponding array ID: eukaryotes_10
tcaggctccctctccggaatcgaac

SEQ ID NO: 71 - DNA, 25 bp, Artificial Sequence
  Corresponding array ID: eukaryotes_11
tctcaggctccctctccggaatcga

SEQ ID NO: 72 - DNA, 25 bp, Artificial Sequence
  Corresponding array ID: eukaryotes_12
tattggagctggaattaccgcggct

SEQ ID NO: 73 - DNA, 25 bp, Artificial Sequence
  Corresponding array ID: eukaryotes_13
attggagctggaattaccgcggctg

SEQ ID NO: 74 - DNA, 25 bp, Artificial Sequence
  Corresponding array ID: eukaryotes_14
taagaacggccatgcaccaccaccc

SEQ ID NO: 75 - DNA, 25 bp, Artificial Sequence
  Corresponding array ID: eukaryotes_15
ctaagaacggccatgcaccaccacc

SEQ ID NO: 76 - DNA, 25 bp, Artificial Sequence
  Corresponding array ID: eukaryotes_16
actaagaacggccatgcaccaccac

SEQ ID NO: 77 - DNA, 25 bp, Artificial Sequence
  Corresponding array ID: eukaryotes_17
ctcaggctccctctccggaatcgaa

SEQ ID NO: 78 - DNA, 25 bp, Artificial Sequence
  Corresponding array ID: eukaryotes_18
ctattggagctggaattaccgcggc

SEQ ID NO: 79 - DNA, 25 bp, Artificial Sequence
  Corresponding array ID: eukaryotes_19
aagaacggccatgcaccaccaccca

SEQ ID NO: 80 - DNA, 25 bp, Artificial Sequence
  Corresponding array ID: eukaryotes_20
aggctccctctccggaatcgaaccc

SEQ ID NO: 81 - DNA, 25 bp, Artificial Sequence
  Corresponding array ID: eukaryotes_21
caggctccctctccggaatcgaacc

SEQ ID NO: 82 - DNA, 25 bp, Artificial Sequence
  Corresponding array ID: eukaryotes_22
gctattggagctggaattaccgcgg

SEQ ID NO: 83 - DNA, 25 bp, Artificial Sequence
  Corresponding array ID: eukaryotes_23
tttctcaggctccctctccggaatc

SEQ ID NO: 84 - DNA, 25 bp, Artificial Sequence
  Corresponding array ID: eukaryotes_24
ggctccctctccggaatcgaaccct

SEQ ID NO: 85 - DNA, 25 bp, Artificial Sequence
  Corresponding array ID: eukaryotes_25
cactccaccaactaagaacggccat

SEQ ID NO: 86 - DNA, 25 bp, Artificial Sequence
  Corresponding array ID: archaea_1
ttgtggtgctcccccgccaattcct

SEQ ID NO: 87 - DNA, 25 bp, Artificial Sequence
  Corresponding array ID: archaea_2
tgctcccccgccaattcctttaagt

SEQ ID NO: 88 - DNA, 25 bp, Artificial Sequence
  Corresponding array ID: archaea_3
cgcgcctgctgcgccccgtagggcc

SEQ ID NO: 89 - DNA, 25 bp, Artificial Sequence
  Corresponding array ID: archaea_4
tttcgcgcctgctgcgccccgtagg

SEQ ID NO: 90 - DNA, 25 bp, Artificial Sequence
  Corresponding array ID: archaea_5
tcgcgcctgctgcgccccgtagggc

SEQ ID NO: 91 - DNA, 25 bp, Artificial Sequence
  Corresponding array ID: archaea_6
ttcgcgcctgctgcgccccgtaggg

SEQ ID NO: 92 - DNA, 25 bp, Artificial Sequence
  Corresponding array ID: archaea_7
gtgctcccccgccaattcctttaag

SEQ ID NO: 93 - DNA, 25 bp, Artificial Sequence
  Corresponding array ID: archaea_8
gctcccccgccaattcctttaagtt

SEQ ID NO: 94 - DNA, 25 bp, Artificial Sequence
  Corresponding array ID: archaea_9
gcgcctgctgcgccccgtagggcct

SEQ ID NO: 95 - DNA, 25 bp, Artificial Sequence
  Corresponding array ID: archaea_10
cgcctgctgcgccccgtagggcctg

SEQ ID NO: 96 - DNA, 25 bp, Artificial Sequence
  Corresponding array ID: archaea_11
gcctgctgcgccccgtagggcctgg

SEQ ID NO: 97 - DNA, 25 bp, Artificial Sequence
  Corresponding array ID: archaea_12
gtttcgcgcctgctgcgccccgtag

SEQ ID NO: 98 - DNA, 25 bp, Artificial Sequence
  Corresponding array ID: archaea_13
cttgtggtgctcccccgccaattcc

SEQ ID NO: 99 - DNA, 25 bp, Artificial Sequence
  Corresponding array ID: archaea_14
ggtttcgcgcctgctgcgccccgta

SEQ ID NO: 100 - DNA, 25 bp, Artificial Sequence
  Corresponding array ID: archaea_15
aggtttcgcgcctgctgcgccccgt

SEQ ID NO: 101 - DNA, 25 bp, Artificial Sequence
  Corresponding array ID: archaea_16
cctgctgcgccccgtagggcctgga

SEQ ID NO: 102 - DNA, 25 bp, Artificial Sequence
  Corresponding array ID: archaea_17
ccttgtggtgctcccccgccaattc

SEQ ID NO: 103 - DNA, 25 bp, Artificial Sequence
  Corresponding array ID: archaea_18
ccccttgtggtgctcccccgccaat

SEQ ID NO: 104 - DNA, 25 bp, Artificial Sequence
  Corresponding array ID: archaea_19
accccttgtggtgctcccccgccaa

SEQ ID NO: 105 - DNA, 25 bp, Artificial Sequence
  Corresponding array ID: archaea_20
cccttgtggtgctcccccgccaatt

SEQ ID NO: 106 - DNA, 25 bp, Artificial Sequence
  Corresponding array ID: archaea_21
caccccttgtggtgctcccccgcca

SEQ ID NO: 107 - DNA, 25 bp, Artificial Sequence
  Corresponding array ID: archaea_22
gtgtgtgcaaggagcagggacgtat

SEQ ID NO: 108 - DNA, 25 bp, Artificial Sequence
  Corresponding array ID: archaea_23
tgtgtgcaaggagcagggacgtatt

SEQ ID NO: 109 - DNA, 25 bp, Artificial Sequence
  Corresponding array ID: archaea_24
cggtgtgtgcaaggagcagggacgt

SEQ ID NO: 110 - DNA, 25 bp, Artificial Sequence
  Corresponding array ID: archaea_25
ggtgtgtgcaaggagcagggacgta

SEQ ID NO: 111 - DNA, 25 bp, Artificial Sequence
  Corresponding array ID: bacteria_1
cgctcgttgcgggacttaacccaac

SEQ ID NO: 112 - DNA, 25 bp, Artificial Sequence
  Corresponding array ID: bacteria_2
gctcgttgcgggacttaacccaaca

SEQ ID NO: 113 - DNA, 25 bp, Artificial Sequence
  Corresponding array ID: bacteria_3
gacttaacccaacatctcacgacac

SEQ ID NO: 114 - DNA, 25 bp, Artificial Sequence
  Corresponding array ID: bacteria_4
aacccaacatctcacgacacgagct

SEQ ID NO: 115 - DNA, 25 bp, Artificial Sequence
  Corresponding array ID: bacteria_5
acttaacccaacatctcacgacacg

SEQ ID NO: 116 - DNA, 25 bp, Artificial Sequence
  Corresponding array ID: bacteria_6
taacccaacatctcacgacacgagc

SEQ ID NO: 117 - DNA, 25 bp, Artificial Sequence
  Corresponding array ID: bacteria_7
ggacttaacccaacatctcacgaca

SEQ ID NO: 118 - DNA, 25 bp, Artificial Sequence
  Corresponding array ID: bacteria_8
cttaacccaacatctcacgacacga

SEQ ID NO: 119 - DNA, 25 bp, Artificial Sequence
  Corresponding array ID: bacteria_9
ttaacccaacatctcacgacacgag

SEQ ID NO: 120 - DNA, 25 bp, Artificial Sequence
  Corresponding array ID: bacteria_10
gggacttaacccaacatctcacgac

SEQ ID NO: 121 - DNA, 25 bp, Artificial Sequence
  Corresponding array ID: bacteria_11
actgctgcctcccgtaggagtctgg

SEQ ID NO: 122 - DNA, 25 bp, Artificial Sequence
  Corresponding array ID: bacteria_12
ctcgttgcgggacttaacccaacat

SEQ ID NO: 123 - DNA, 25 bp, Artificial Sequence
  Corresponding array ID: bacteria_13
cgggacttaacccaacatctcacga

SEQ ID NO: 124 - DNA, 25 bp, Artificial Sequence
  Corresponding array ID: bacteria_14
tcgttgcgggacttaacccaacatc

SEQ ID NO: 125 - DNA, 25 bp, Artificial Sequence
  Corresponding array ID: bacteria_15
cgttgcgggacttaacccaacatct

SEQ ID NO: 126 - DNA, 25 bp, Artificial Sequence
  Corresponding array ID: bacteria_16
gttgcgggacttaacccaacatctc

SEQ ID NO: 127 - DNA, 25 bp, Artificial Sequence
  Corresponding array ID: bacteria_17
tgcgggacttaacccaacatctcac

SEQ ID NO: 128 - DNA, 25 bp, Artificial Sequence
  Corresponding array ID: bacteria_18
ttgcgggacttaacccaacatctca

SEQ ID NO: 129 - DNA, 25 bp, Artificial Sequence
  Corresponding array ID: bacteria_19
ccccactgctgcctcccgtaggagt

SEQ ID NO: 130 - DNA, 25 bp, Artificial Sequence
  Corresponding array ID: bacteria_20
gcgggacttaacccaacatctcacg

SEQ ID NO: 131 - DNA, 25 bp, Artificial Sequence
  Corresponding array ID: bacteria_21
gcgctcgttgcgggacttaacccaa

SEQ ID NO: 132 - DNA, 25 bp, Artificial Sequence
  Corresponding array ID: bacteria_22
tccccactgctgcctcccgtaggag

SEQ ID NO: 133 - DNA, 25 bp, Artificial Sequence
  Corresponding array ID: bacteria_23
attccccactgctgcctcccgtagg

SEQ ID NO: 134 - DNA, 25 bp, Artificial Sequence
  Corresponding array ID: bacteria_24
ttccccactgctgcctcccgtagga

SEQ ID NO: 135 - DNA, 25 bp, Artificial Sequence
  Corresponding array ID: bacteria_25
acccaacatctcacgacacgagctg

SEQ ID NO: 136 - DNA, 25 bp, Artificial Sequence
  Corresponding array ID: rhodobacter_1
tccccaggcggaatgcttaatccgt

SEQ ID NO: 137 - DNA, 25 bp, Artificial Sequence
  Corresponding array ID: rhodobacter_2
ctccccaggcggaatgcttaatccg

SEQ ID NO: 138 - DNA, 25 bp, Artificial Sequence
  Corresponding array ID: rhodobacter_3
actccccaggcggaatgcttaatcc

SEQ ID NO: 139 - DNA, 25 bp, Artificial Sequence
  Corresponding array ID: rhodobacter_4
ccccaggcggaatgcttaatccgtt

SEQ ID NO: 140 - DNA, 25 bp, Artificial Sequence
  Corresponding array ID: rhodobacter_5
caccgcgtcatgctgttacgcgatt

SEQ ID NO: 141 - DNA, 25 bp, Artificial Sequence
  Corresponding array ID: rhodobacter_6
tcaccgcgtcatgctgttacgcgat

SEQ ID NO: 142 - DNA, 25 bp, Artificial Sequence
  Corresponding array ID: rhodobacter_7
attcaccgcgtcatgctgttacgcg

SEQ ID NO: 143 - DNA, 25 bp, Artificial Sequence
  Corresponding array ID: rhodobacter_8
tagcccaacccgtaagggccatgag

SEQ ID NO: 144 - DNA, 25 bp, Artificial Sequence
  Corresponding array ID: rhodobacter_9
tactccccaggcggaatgcttaatc

SEQ ID NO: 145 - DNA, 25 bp, Artificial Sequence
  Corresponding array ID: rhodobacter_10
agcccaacccgtaagggccatgagg

SEQ ID NO: 146 - DNA, 25 bp, Artificial Sequence
  Corresponding array ID: rhodobacter_11
gcccaacccgtaagggccatgagga

SEQ ID NO: 147 - DNA, 25 bp, Artificial Sequence
  Corresponding array ID: rhodobacter_12
aacgtattcaccgcgtcatgctgtt

SEQ ID NO: 148 - DNA, 25 bp, Artificial Sequence
  Corresponding array ID: rhodobacter_13
ttcaccgcgtcatgctgttacgcga

SEQ ID NO: 149 - DNA, 25 bp, Artificial Sequence
  Corresponding array ID: rhodobacter_14
accgcgtcatgctgttacgcgatta

SEQ ID NO: 150 - DNA, 25 bp, Artificial Sequence
  Corresponding array ID: rhodobacter_15
gcggaatgcttaatccgttaggtgt

SEQ ID NO: 151 - DNA, 25 bp, Artificial Sequence
  Corresponding array ID: rhodobacter_16
ccaacccgtaagggccatgaggact

SEQ ID NO: 152 - DNA, 25 bp, Artificial Sequence
  Corresponding array ID: rhodobacter_17
cccaggcggaatgcttaatccgtta

SEQ ID NO: 153 - DNA, 25 bp, Artificial Sequence
  Corresponding array ID: rhodobacter_18
cccaacccgtaagggccatgaggac

SEQ ID NO: 154 - DNA, 25 bp, Artificial Sequence
  Corresponding array ID: rhodobacter_19
aattccactcacctctctcgaactc

SEQ ID NO: 155 - DNA, 25 bp, Artificial Sequence
  Corresponding array ID: rhodobacter_20
gaattccactcacctctctcgaact

SEQ ID NO: 156 - DNA, 25 bp, Artificial Sequence
  Corresponding array ID: rhodobacter_21
tattcaccgcgtcatgctgttacgc

SEQ ID NO: 157 - DNA, 25 bp, Artificial Sequence
  Corresponding array ID: rhodobacter_22
acgtattcaccgcgtcatgctgtta

SEQ ID NO: 158 - DNA, 25 bp, Artificial Sequence
  Corresponding array ID: rhodobacter_23
gaacgtattcaccgcgtcatgctgt

SEQ ID NO: 159 - DNA, 25 bp, Artificial Sequence
  Corresponding array ID: rhodobacter_24
ggaattccactcacctctctcgaac

SEQ ID NO: 160 - DNA, 25 bp, Artificial Sequence
  Corresponding array ID: rhodobacter_25
gtagcccaacccgtaagggccatga

SEQ ID NO: 161 - DNA, 25 bp, Artificial Sequence
  Corresponding array ID: margrpA_1
acgaagttagccggtgctttcttgt

SEQ ID NO: 162 - DNA, 25 bp, Artificial Sequence
  Corresponding array ID: margrpA_2
cacgaagttagccggtgctttcttg

SEQ ID NO: 163 - DNA, 25 bp, Artificial Sequence
  Corresponding array ID: margrpA_3
gttactcacccgttcgccagtttac

SEQ ID NO: 164 - DNA, 25 bp, Artificial Sequence
  Corresponding array ID: margrpA_4
taagggacatactgacttgacatca

SEQ ID NO: 165 - DNA, 25 bp, Artificial Sequence
  Corresponding array ID: margrpA_5
ataagggacatactgacttgacatc

SEQ ID NO: 166 - DNA, 25 bp, Artificial Sequence
  Corresponding array ID: margrpA_6
aagggacatactgacttgacatcat

SEQ ID NO: 167 - DNA, 25 bp, Artificial Sequence
  Corresponding array ID: margrpA_7
ttactcacccgttcgccagtttact

SEQ ID NO: 168 - DNA, 25 bp, Artificial Sequence
  Corresponding array ID: margrpA_8
cgttactcacccgttcgccagttta

SEQ ID NO: 169 - DNA, 25 bp, Artificial Sequence
  Corresponding array ID: margrpA_9
gcgttactcacccgttcgccagttt

SEQ ID NO: 170 - DNA, 25 bp, Artificial Sequence
  Corresponding array ID: margrpA_10
cgcgttactcacccgttcgccagtt

SEQ ID NO: 171 - DNA, 25 bp, Artificial Sequence
  Corresponding array ID: margrpA_11
acatactgacttgacatcatcccca

SEQ ID NO: 172 - DNA, 25 bp, Artificial Sequence
  Corresponding array ID: margrpA_12
tactgacttgacatcatccccacct

SEQ ID NO: 173 - DNA, 25 bp, Artificial Sequence
  Corresponding array ID: margrpA_13
ggacatactgacttgacatcatccc

SEQ ID NO: 174 - DNA, 25 bp, Artificial Sequence
  Corresponding array ID: margrpA_14
gacatactgacttgacatcatcccc

SEQ ID NO: 175 - DNA, 25 bp, Artificial Sequence
  Corresponding array ID: margrpA_15
atactgacttgacatcatccccacc

SEQ ID NO: 176 - DNA, 25 bp, Artificial Sequence
  Corresponding array ID: margrpA_16
catactgacttgacatcatccccac

SEQ ID NO: 177 - DNA, 25 bp, Artificial Sequence
  Corresponding array ID: margrpA_17
agggacatactgacttgacatcatc

SEQ ID NO: 178 - DNA, 25 bp, Artificial Sequence
  Corresponding array ID: margrpA_18
gggacatactgacttgacatcatcc

SEQ ID NO: 179 - DNA, 25 bp, Artificial Sequence
  Corresponding array ID: margrpA_19
acgcgttactcacccgttcgccagt

SEQ ID NO: 180 - DNA, 25 bp, Artificial Sequence
  Corresponding array ID: margrpA_20
gcacgaagttagccggtgctttctt

SEQ ID NO: 181 - DNA, 25 bp, Artificial Sequence
  Corresponding array ID: margrpA_21
ggcacgaagttagccggtgctttct

SEQ ID NO: 182 - DNA, 25 bp, Artificial Sequence
  Corresponding array ID: margrpA_22
tggcacgaagttagccggtgctttc

SEQ ID NO: 183 - DNA, 25 bp, Artificial Sequence
  Corresponding array ID: margrpA_23
actgacttgacatcatccccacctt

SEQ ID NO: 184 - DNA, 25 bp, Artificial Sequence
  Corresponding array ID: margrpA_24
ctggcacgaagttagccggtgcttt

SEQ ID NO: 185 - DNA, 25 bp, Artificial Sequence
  Corresponding array ID: margrpA_25
acgattactagcgattcctgcttca

SEQ ID NO: 186 - DNA, 25 bp, Artificial Sequence
  Corresponding array ID: vibrionaceae_1
tatcccccacatcagggcaatttcc

SEQ ID NO: 187 - DNA, 25 bp, Artificial Sequence
  Corresponding array ID: vibrionaceae_2
cgacattactcgctggcaaacaagg

SEQ ID NO: 188 - DNA, 25 bp, Artificial Sequence
  Corresponding array ID: vibrionaceae_3
ccgacattactcgctggcaaacaag

SEQ ID NO: 189 - DNA, 25 bp, Artificial Sequence
  Corresponding array ID: vibrionaceae_4
ccccacatcagggcaatttcctagg

SEQ ID NO: 190 - DNA, 25 bp, Artificial Sequence
  Corresponding array ID: vibrionaceae_5
cccccacatcagggcaatttcctag

SEQ ID NO: 191 - DNA, 25 bp, Artificial Sequence
  Corresponding array ID: vibrionaceae_6
cccacatcagggcaatttcctaggc

SEQ ID NO: 192 - DNA, 25 bp, Artificial Sequence
  Corresponding array ID: vibrionaceae_7
ccacatcagggcaatttcctaggca

SEQ ID NO: 193 - DNA, 25 bp, Artificial Sequence
  Corresponding array ID: vibrionaceae_8
tcccccacatcagggcaatttccta

SEQ ID NO: 194 - DNA, 25 bp, Artificial Sequence
  Corresponding array ID: vibrionaceae_9
cccgacattactcgctggcaaacaa

SEQ ID NO: 195 - DNA, 25 bp, Artificial Sequence
  Corresponding array ID: vibrionaceae_10
atcccccacatcagggcaatttcct

SEQ ID NO: 196 - DNA, 25 bp, Artificial Sequence
  Corresponding array ID: vibrionaceae_11
tggttatcccccacatcagggcaat

SEQ ID NO: 197 - DNA, 25 bp, Artificial Sequence
  Corresponding array ID: vibrionaceae_12
cccccacatcagggcaatttcccag

SEQ ID NO: 198 - DNA, 25 bp, Artificial Sequence
  Corresponding array ID: vibrionaceae_13
tcccccacatcagggcaatttccca

SEQ ID NO: 199 - DNA, 25 bp, Artificial Sequence
  Corresponding array ID: vibrionaceae_14
ccccacatcagggcaatttcccagg

SEQ ID NO: 200 - DNA, 25 bp, Artificial Sequence
  Corresponding array ID: vibrionaceae_15
cccacatcagggcaatttcccaggc

SEQ ID NO: 201 - DNA, 25 bp, Artificial Sequence
  Corresponding array ID: vibrionaceae_16
cacatcagggcaatttcccaggcat

SEQ ID NO: 202 - DNA, 25 bp, Artificial Sequence
  Corresponding array ID: vibrionaceae_17
ccacatcagggcaatttcccaggca

SEQ ID NO: 203 - DNA, 25 bp, Artificial Sequence
  Corresponding array ID: vibrionaceae_18
atcccccacatcagggcaatttccc

SEQ ID NO: 204 - DNA, 25 bp, Artificial Sequence
  Corresponding array ID: vibrionaceae_19
tcccgacattactcgctggcaaaca

SEQ ID NO: 205 - DNA, 25 bp, Artificial Sequence
  Corresponding array ID: vibrionaceae_20
ggttatcccccacatcagggcaatt

SEQ ID NO: 206 - DNA, 25 bp, Artificial Sequence
  Corresponding array ID: vibrionaceae_21
cgcaagttggccgccctctgtatgc

SEQ ID NO: 207 - DNA, 25 bp, Artificial Sequence
  Corresponding array ID: vibrionaceae_22
gcaagttggccgccctctgtatgcg

SEQ ID NO: 208 - DNA, 25 bp, Artificial Sequence
  Corresponding array ID: vibrionaceae_23
atggttatcccccacatcagggcaa

SEQ ID NO: 209 - DNA, 25 bp, Artificial Sequence
  Corresponding array ID: vibrionaceae_24
actcgctggcaaacaaggataaggg

SEQ ID NO: 210 - DNA, 25 bp, Artificial Sequence
  Corresponding array ID: vibrionaceae_25
cgcatctgagtgtcagtatctgtcc

SEQ ID NO: 211 - DNA, 25 bp, Artificial Sequence
  Corresponding array ID: alteromonadales_1
cccacttgggccaatctaaaggcga

SEQ ID NO: 212 - DNA, 25 bp, Artificial Sequence
  Corresponding array ID: alteromonadales_2
atcccacttgggccaatctaaaggc

SEQ ID NO: 213 - DNA, 25 bp, Artificial Sequence
  Corresponding array ID: alteromonadales_3
tcccacttgggccaatctaaaggcg

SEQ ID NO: 214 - DNA, 25 bp, Artificial Sequence
  Corresponding array ID: alteromonadales_4
ccacttgggccaatctaaaggcgag

SEQ ID NO: 215 - DNA, 25 bp, Artificial Sequence
  Corresponding array ID: alteromonadales_5
cacttgggccaatctaaaggcgaga

SEQ ID NO: 216 - DNA, 25 bp, Artificial Sequence
  Corresponding array ID: alteromonadales_6
acttgggccaatctaaaggcgagag

SEQ ID NO: 217 - DNA, 25 bp, Artificial Sequence
  Corresponding array ID: alteromonadales_7
cttgggccaatctaaaggcgagagc

SEQ ID NO: 218 - DNA, 25 bp, Artificial Sequence
  Corresponding array ID: alteromonadales_8
cacctcaaggcatgttcccaagcat

SEQ ID NO: 219 - DNA, 25 bp, Artificial Sequence
  Corresponding array ID: alteromonadales_9
tgagcgtcagtgttgacccaggtgg

SEQ ID NO: 220 - DNA, 25 bp, Artificial Sequence
  Corresponding array ID: alteromonadales_10
cgaagccccctttggtccgtagaca

SEQ ID NO: 221 - DNA, 25 bp, Artificial Sequence
  Corresponding array ID: alteromonadales_11
acagaaccgaggttccgagcttcta

SEQ ID NO: 222 - DNA, 25 bp, Artificial Sequence
  Corresponding array ID: alteromonadales_12
cagaaccgaggttccgagcttctag

SEQ ID NO: 223 - DNA, 25 bp, Artificial Sequence
  Corresponding array ID: alteromonadales_13
agaaccgaggttccgagcttctagt

SEQ ID NO: 224 - DNA, 25 bp, Artificial Sequence
  Corresponding array ID: alteromonadales_14
gaaaaacagaaccgaggttccgagc

SEQ ID NO: 225 - DNA, 25 bp, Artificial Sequence
  Corresponding array ID: alteromonadales_15
gaaccgaggttccgagcttctagta

SEQ ID NO: 226 - DNA, 25 bp, Artificial Sequence
  Corresponding array ID: alteromonadales_16
ccgaggttccgagcttctagtagac

SEQ ID NO: 227 - DNA, 25 bp, Artificial Sequence
  Corresponding array ID: alteromonadales_17
cgaggttccgagcttctagtagaca

SEQ ID NO: 228 - DNA, 25 bp, Artificial Sequence
  Corresponding array ID: alteromonadales_18
aaccgaggttccgagcttctagtag

SEQ ID NO: 229 - DNA, 25 bp, Artificial Sequence
  Corresponding array ID: alteromonadales_19
accgaggttccgagcttctagtaga

SEQ ID NO: 230 - DNA, 25 bp, Artificial Sequence
  Corresponding array ID: alteromonadales_20
aacagaaccgaggttccgagcttct

SEQ ID NO: 231 - DNA, 25 bp, Artificial Sequence
  Corresponding array ID: alteromonadales_21
aaacagaaccgaggttccgagcttc

SEQ ID NO: 232 - DNA, 25 bp, Artificial Sequence
  Corresponding array ID: alteromonadales_22
ccgaagccccctttggtccgtagac

SEQ ID NO: 233 - DNA, 25 bp, Artificial Sequence
  Corresponding array ID: alteromonadales_23
gaagccccctttggtccgtagacat

SEQ ID NO: 234 - DNA, 25 bp, Artificial Sequence
  Corresponding array ID: alteromonadales_24
aagccccctttggtccgtagacatt

SEQ ID NO: 235 - DNA, 25 bp, Artificial Sequence
  Corresponding array ID: alteromonadales_25
ccacctcaaggcatgttcccaagca

SEQ ID NO: 236 - DNA, 25 bp, Artificial Sequence
  Corresponding array ID: polaribacters_1
gccagatggctgctcattgtccata

SEQ ID NO: 237 - DNA, 25 bp, Artificial Sequence
  Corresponding array ID: polaribacters_2
tgccagatggctgctcattgtccat

SEQ ID NO: 238 - DNA, 25 bp, Artificial Sequence
  Corresponding array ID: polaribacters_3
ttgccagatggctgctcattgtcca

SEQ ID NO: 239 - DNA, 25 bp, Artificial Sequence
  Corresponding array ID: polaribacters_4
ccagatggctgctcattgtccatac

SEQ ID NO: 240 - DNA, 25 bp, Artificial Sequence
  Corresponding array ID: polaribacters_5
gttgccagatggctgctcattgtcc

SEQ ID NO: 241 - DNA, 25 bp, Artificial Sequence
  Corresponding array ID: polaribacters_6
tccctcagcgtcagtacatacgtag

SEQ ID NO: 242 - DNA, 25 bp, Artificial Sequence
  Corresponding array ID: polaribacters_7
ccctcagcgtcagtacatacgtagt

SEQ ID NO: 243 - DNA, 25 bp, Artificial Sequence
  Corresponding array ID: polaribacters_8
gtccctcagcgtcagtacatacgta

SEQ ID NO: 244 - DNA, 25 bp, Artificial Sequence
  Corresponding array ID: polaribacters_9
cagatggctgctcattgtccatacc

SEQ ID NO: 245 - DNA, 25 bp, Artificial Sequence
  Corresponding array ID: polaribacters_10
ttcgcatagtggctgctcattgtcc

SEQ ID NO: 246 - DNA, 25 bp, Artificial Sequence
  Corresponding array ID: polaribacters_11
cgtccctcagcgtcagtacatacgt

SEQ ID NO: 247 - DNA, 25 bp, Artificial Sequence
  Corresponding array ID: polaribacters_12
agaccccctacctatcgttgccatg

SEQ ID NO: 248 - DNA, 25 bp, Artificial Sequence
  Corresponding array ID: polaribacters_13
cgcttagtcactgagctaatgccca

SEQ ID NO: 249 - DNA, 25 bp, Artificial Sequence
  Corresponding array ID: polaribacters_14
tgttgccagatggctgctcattgtc

SEQ ID NO: 250 - DNA, 25 bp, Artificial Sequence
  Corresponding array ID: polaribacters_15
gattcgctcctattcgcatagtggc

SEQ ID NO: 251 - DNA, 25 bp, Artificial Sequence
  Corresponding array ID: polaribacters_16
tcgtccctcagcgtcagtacatacg

SEQ ID NO: 252 - DNA, 25 bp, Artificial Sequence
  Corresponding array ID: polaribacters_17
tcgcttagtcactgagctaatgccc

SEQ ID NO: 253 - DNA, 25 bp, Artificial Sequence
  Corresponding array ID: polaribacters_18
tcgcatagtggctgctcattgtcca

SEQ ID NO: 254 - DNA, 25 bp, Artificial Sequence
  Corresponding array ID: polaribacters_19
cagaccccctacctatcgttgccat

SEQ ID NO: 255 - DNA, 25 bp, Artificial Sequence
  Corresponding array ID: polaribacters_20
ttcgtccctcagcgtcagtacatac

SEQ ID NO: 256 - DNA, 25 bp, Artificial Sequence
  Corresponding array ID: polaribacters_21
ctctctgttgccagatggctgctca

SEQ ID NO: 257 - DNA, 25 bp, Artificial Sequence
  Corresponding array ID: polaribacters_22
gcagattctatacgcgttacgcacc

SEQ ID NO: 258 - DNA, 25 bp, Artificial Sequence
  Corresponding array ID: polaribacters_23
ggcagattctatacgcgttacgcac

SEQ ID NO: 259 - DNA, 25 bp, Artificial Sequence
  Corresponding array ID: polaribacters_24
cacctctgacttaattgaccgcctg

SEQ ID NO: 260 - DNA, 25 bp, Artificial Sequence
  Corresponding array ID: polaribacters_25
cctctgacttaattgaccgcctgcg

SEQ ID NO: 261 - DNA, 25 bp, Artificial Sequence
  Corresponding array ID: desulfovibrionales_1
cccgagcatgctgatctcgaattac

SEQ ID NO: 262 - DNA, 25 bp, Artificial Sequence
  Corresponding array ID: desulfovibrionales_2
cacccgagcatgctgatctcgaatt

SEQ ID NO: 263 - DNA, 25 bp, Artificial Sequence
  Corresponding array ID: desulfovibrionales_3
tcacccgagcatgctgatctcgaat

SEQ ID NO: 264 - DNA, 25 bp, Artificial Sequence
  Corresponding array ID: desulfovibrionales_4
ttcacccgagcatgctgatctcgaa

SEQ ID NO: 265 - DNA, 25 bp, Artificial Sequence
  Corresponding array ID: desulfovibrionales_5
gcaccctctaatttcctagaggtcc

SEQ ID NO: 266 - DNA, 25 bp, Artificial Sequence
  Corresponding array ID: desulfovibrionales_6
agggcaccctctaatttcctagagg

SEQ ID NO: 267 - DNA, 25 bp, Artificial Sequence
  Corresponding array ID: desulfovibrionales_7
gggcaccctctaatttcctagaggt

SEQ ID NO: 268 - DNA, 25 bp, Artificial Sequence
  Corresponding array ID: desulfovibrionales_8
ccctctaatttcctagaggtcccct

SEQ ID NO: 269 - DNA, 25 bp, Artificial Sequence
  Corresponding array ID: desulfovibrionales_9
accctctaatttcctagaggtcccc

SEQ ID NO: 270 - DNA, 25 bp, Artificial Sequence
  Corresponding array ID: desulfovibrionales_10
atttcctagaggtcccctggatgtc

SEQ ID NO: 271 - DNA, 25 bp, Artificial Sequence
  Corresponding array ID: desulfovibrionales_11
agggtaccgtcaaatgcctacccta

SEQ ID NO: 272 - DNA, 25 bp, Artificial Sequence
  Corresponding array ID: desulfovibrionales_12
gagggtaccgtcaaatgcctaccct

SEQ ID NO: 273 - DNA, 25 bp, Artificial Sequence
  Corresponding array ID: desulfovibrionales_13
gggtaccgtcaaatgcctaccctat

SEQ ID NO: 274 - DNA, 25 bp, Artificial Sequence
  Corresponding array ID: desulfovibrionales_14
tttcctagaggtcccctggatgtca

SEQ ID NO: 275 - DNA, 25 bp, Artificial Sequence
  Corresponding array ID: desulfovibrionales_15
ttcctagaggtcccctggatgtcaa

SEQ ID NO: 276 - DNA, 25 bp, Artificial Sequence
  Corresponding array ID: desulfovibrionales_16
tgagggtaccgtcaaatgcctaccc

SEQ ID NO: 277 - DNA, 25 bp, Artificial Sequence
  Corresponding array ID: desulfovibrionales_17
ctctaatttcctagaggtcccctgg

SEQ ID NO: 278 - DNA, 25 bp, Artificial Sequence
  Corresponding array ID: desulfovibrionales_18
caccctctaatttcctagaggtccc

SEQ ID NO: 279 - DNA, 25 bp, Artificial Sequence
  Corresponding array ID: desulfovibrionales_19
ggcaccctctaatttcctagaggtc

SEQ ID NO: 280 - DNA, 25 bp, Artificial Sequence
  Corresponding array ID: desulfovibrionales_20
cctctaatttcctagaggtcccctg

SEQ ID NO: 281 - DNA, 25 bp, Artificial Sequence
  Corresponding array ID: desulfovibrionales_21
caaccgttatccccgtcttgaaggt

SEQ ID NO: 282 - DNA, 25 bp, Artificial Sequence
  Corresponding array ID: desulfovibrionales_22
atcaaaggctgttccaccgttgagc

SEQ ID NO: 283 - DNA, 25 bp, Artificial Sequence
  Corresponding array ID: desulfovibrionales_23
ttgctcgttagctcgccggcttcgg

SEQ ID NO: 284 - DNA, 25 bp, Artificial Sequence
  Corresponding array ID: desulfovibrionales_24
attgctcgttagctcgccggcttcg

SEQ ID NO: 285 - DNA, 25 bp, Artificial Sequence
  Corresponding array ID: desulfovibrionales_25
cctagaggtcccctggatgtcaagc

SEQ ID NO: 286 - DNA, 25 bp, Artificial Sequence
  Corresponding array ID: aquaficae_1
aaccagacgctccaccggttgtgcg

SEQ ID NO: 287 - DNA, 25 bp, Artificial Sequence
  Corresponding array ID: aquaficae_2
accagacgctccaccggttgtgcgg

SEQ ID NO: 288 - DNA, 25 bp, Artificial Sequence
  Corresponding array ID: aquaficae_3
aaaccagacgctccaccggttgtgc

SEQ ID NO: 289 - DNA, 25 bp, Artificial Sequence
  Corresponding array ID: aquaficae_4
tgccactgtagcgcctgtgtagccc

SEQ ID NO: 290 - DNA, 25 bp, Artificial Sequence
  Corresponding array ID: aquaficae_5
taaaccagacgctccaccggttgtg

SEQ ID NO: 291 - DNA, 25 bp, Artificial Sequence
  Corresponding array ID: aquaficae_6
gccactgtagcgcctgtgtagccca

SEQ ID NO: 292 - DNA, 25 bp, Artificial Sequence
  Corresponding array ID: aquaficae_7
ccagacgctccaccggttgtgcggg

SEQ ID NO: 293 - DNA, 25 bp, Artificial Sequence
  Corresponding array ID: aquaficae_8
ccactgtagcgcctgtgtagcccag

SEQ ID NO: 294 - DNA, 25 bp, Artificial Sequence
  Corresponding array ID: aquaficae_9
gcataaagggcatactgacctgacg

SEQ ID NO: 295 - DNA, 25 bp, Artificial Sequence
  Corresponding array ID: aquaficae_10
ttaaaccagacgctccaccggttgt

SEQ ID NO: 296 - DNA, 25 bp, Artificial Sequence
  Corresponding array ID: aquaficae_11
cattgcccacgattccccactgctg

SEQ ID NO: 297 - DNA, 25 bp, Artificial Sequence
  Corresponding array ID: aquaficae_12
attgcccacgattccccactgctgc

SEQ ID NO: 298 - DNA, 25 bp, Artificial Sequence
  Corresponding array ID: aquaficae_13
ccattgcccacgattccccactgct

SEQ ID NO: 299 - DNA, 25 bp, Artificial Sequence
  Corresponding array ID: aquaficae_14
gcccattgcccacgattccccactg

SEQ ID NO: 300 - DNA, 25 bp, Artificial Sequence
  Corresponding array ID: aquaficae_15
cccattgcccacgattccccactgc

SEQ ID NO: 301 - DNA, 25 bp, Artificial Sequence
  Corresponding array ID: aquaficae_16
cgcccattgcccacgattccccact

SEQ ID NO: 302 - DNA, 25 bp, Artificial Sequence
  Corresponding array ID: aquaficae_17
tgcccacgattccccactgctgccc

SEQ ID NO: 303 - DNA, 25 bp, Artificial Sequence
  Corresponding array ID: aquaficae_18
attaaaccagacgctccaccggttg

SEQ ID NO: 304 - DNA, 25 bp, Artificial Sequence
  Corresponding array ID: aquaficae_19
ttgcccacgattccccactgctgcc

SEQ ID NO: 305 - DNA, 25 bp, Artificial Sequence
  Corresponding array ID: aquaficae_20
gcccacgattccccactgctgcccc

SEQ ID NO: 306 - DNA, 25 bp, Artificial Sequence
  Corresponding array ID: aquaficae_21
cagacgctccaccggttgtgcgggc

SEQ ID NO: 307 - DNA, 25 bp, Artificial Sequence
  Corresponding array ID: aquaficae_22
ggcataaagggcatactgacctgac

SEQ ID NO: 308 - DNA, 25 bp, Artificial Sequence
  Corresponding array ID: aquaficae_23
gcagttcggaatgccttgccgaagt

SEQ ID NO: 309 - DNA, 25 bp, Artificial Sequence
  Corresponding array ID: aquaficae_24
cagttcggaatgccttgccgaagtt

SEQ ID NO: 310 - DNA, 25 bp, Artificial Sequence
  Corresponding array ID: aquaficae_25
cgcagttcggaatgccttgccgaag

SEQ ID NO: 311 - DNA, 25 bp, Artificial Sequence
  Corresponding array ID: bacilli_1
cactctgctcccgaaggagaagccc

SEQ ID NO: 312 - DNA, 25 bp, Artificial Sequence
  Corresponding array ID: bacilli_2
gtcactctgctcccgaaggagaagc

SEQ ID NO: 313 - DNA, 25 bp, Artificial Sequence
  Corresponding array ID: bacilli_3
ctgctcccgaaggagaagccctatc

SEQ ID NO: 314 - DNA, 25 bp, Artificial Sequence
  Corresponding array ID: bacilli_4
tcactctgctcccgaaggagaagcc

SEQ ID NO: 315 - DNA, 25 bp, Artificial Sequence
  Corresponding array ID: bacilli_5
tctgctcccgaaggagaagccctat

SEQ ID NO: 316 - DNA, 25 bp, Artificial Sequence
  Corresponding array ID: bacilli_6
tgctcccgaaggagaagccctatct

SEQ ID NO: 317 - DNA, 25 bp, Artificial Sequence
  Corresponding array ID: bacilli_7
ctctgctcccgaaggagaagcccta

SEQ ID NO: 318 - DNA, 25 bp, Artificial Sequence
  Corresponding array ID: bacilli_8
gctcccgaaggagaagccctatctc

SEQ ID NO: 319 - DNA, 25 bp, Artificial Sequence
  Corresponding array ID: bacilli_9
actctgctcccgaaggagaagccct

SEQ ID NO: 320 - DNA, 25 bp, Artificial Sequence
  Corresponding array ID: bacilli_10
ccgaagccgcctttcaatttcgaac

SEQ ID NO: 321 - DNA, 25 bp, Artificial Sequence
  Corresponding array ID: bacilli_11
cgtccgccgctaacttcataagagc

SEQ ID NO: 322 - DNA, 25 bp, Artificial Sequence
  Corresponding array ID: bacilli_12
gtccgccgctaacttcataagagca

SEQ ID NO: 323 - DNA, 25 bp, Artificial Sequence
  Corresponding array ID: bacilli_13
ccgccgctaacttcataagagcaag

SEQ ID NO: 324 - DNA, 25 bp, Artificial Sequence
  Corresponding array ID: bacilli_14
agccgaagccgcctttcaatttcga

SEQ ID NO: 325 - DNA, 25 bp, Artificial Sequence
  Corresponding array ID: bacilli_15
ctcccgaaggagaagccctatctct

SEQ ID NO: 326 - DNA, 25 bp, Artificial Sequence
  Corresponding array ID: bacilli_16
cagccgaagccgcctttcaatttcg

SEQ ID NO: 327 - DNA, 25 bp, Artificial Sequence
  Corresponding array ID: bacilli_17
ctgtcactctgctcccgaaggagaa

SEQ ID NO: 328 - DNA, 25 bp, Artificial Sequence
  Corresponding array ID: bacilli_18
gccgaagccgcctttcaatttcgaa

SEQ ID NO: 329 - DNA, 25 bp, Artificial Sequence
  Corresponding array ID: bacilli_19
cccgtccgccgctaacttcataaga

SEQ ID NO: 330 - DNA, 25 bp, Artificial Sequence
  Corresponding array ID: bacilli_20
ccgtccgccgctaacttcataagag

SEQ ID NO: 331 - DNA, 25 bp, Artificial Sequence
  Corresponding array ID: bacilli_21
cgccgctaacttcataagagcaagc

SEQ ID NO: 332 - DNA, 25 bp, Artificial Sequence
  Corresponding array ID: bacilli_22
cccgaaggagaagccctatctctag

SEQ ID NO: 333 - DNA, 25 bp, Artificial Sequence
  Corresponding array ID: bacilli_23
cgaaggagaagccctatctctaggg

SEQ ID NO: 334 - DNA, 25 bp, Artificial Sequence
  Corresponding array ID: bacilli_24
ccgaaggagaagccctatctctagg

SEQ ID NO: 335 - DNA, 25 bp, Artificial Sequence
  Corresponding array ID: bacilli_25
tgtcactctgctcccgaaggagaag

SEQ ID NO: 336 - DNA, 25 bp, Artificial Sequence
  Corresponding array ID: crenarch_1_1
agcctgtacgttgagcgtacagatt

SEQ ID NO: 337 - DNA, 25 bp, Artificial Sequence
  Corresponding array ID: crenarch_1_2
cctgtacgttgagcgtacagattta

SEQ ID NO: 338 - DNA, 25 bp, Artificial Sequence
  Corresponding array ID: crenarch_1_3
gcctgtacgttgagcgtacagattt

SEQ ID NO: 339 - DNA, 25 bp, Artificial Sequence
  Corresponding array ID: crenarch_1_4
gagcgtacagatttaaccgaaaact

SEQ ID NO: 340 - DNA, 25 bp, Artificial Sequence
  Corresponding array ID: crenarch_1_5
tgagcgtacagatttaaccgaaaac

SEQ ID NO: 341 - DNA, 25 bp, Artificial Sequence
  Corresponding array ID: crenarch_1_6
cagcctgtacgttgagcgtacagat

SEQ ID NO: 342 - DNA, 25 bp, Artificial Sequence
  Corresponding array ID: crenarch_1_7
ccttgtcacgaacctcaagttcgat

SEQ ID NO: 343 - DNA, 25 bp, Artificial Sequence
  Corresponding array ID: crenarch_1_8
cttgtcacgaacctcaagttcgata

SEQ ID NO: 344 - DNA, 25 bp, Artificial Sequence
  Corresponding array ID: crenarch_1_9
ttgtcacgaacctcaagttcgataa

SEQ ID NO: 345 - DNA, 25 bp, Artificial Sequence
  Corresponding array ID: crenarch_1_10
ctgtacgttgagcgtacagatttaa

SEQ ID NO: 346 - DNA, 25 bp, Artificial Sequence
  Corresponding array ID: crenarch_1_11
gtcacgaacctcaagttcgataacg

SEQ ID NO: 347 - DNA, 25 bp, Artificial Sequence
  Corresponding array ID: crenarch_1_12
ttcccttgtcacgaacctcaagttc

SEQ ID NO: 348 - DNA, 25 bp, Artificial Sequence
  Corresponding array ID: crenarch_1_13
tcacgaacctcaagttcgataacgc

SEQ ID NO: 349 - DNA, 25 bp, Artificial Sequence
  Corresponding array ID: crenarch_1_14
tgtcacgaacctcaagttcgataac

SEQ ID NO: 350 - DNA, 25 bp, Artificial Sequence
  Corresponding array ID: crenarch_1_15
ctgcagcactgcattggccacaagc

SEQ ID NO: 351 - DNA, 25 bp, Artificial Sequence
  Corresponding array ID: crenarch_1_16
gcagcctgtacgttgagcgtacaga

SEQ ID NO: 352 - DNA, 25 bp, Artificial Sequence
  Corresponding array ID: crenarch_1_17
cacgaacctcaagttcgataacgcc

SEQ ID NO: 353 - DNA, 25 bp, Artificial Sequence
  Corresponding array ID: crenarch_1_18
tgtacgttgagcgtacagatttaac

SEQ ID NO: 354 - DNA, 25 bp, Artificial Sequence
  Corresponding array ID: crenarch_1_19
cgttgagcgtacagatttaaccgaa

SEQ ID NO: 355 - DNA, 25 bp, Artificial Sequence
  Corresponding array ID: crenarch_1_20
gtacgttgagcgtacagatttaacc

SEQ ID NO: 356 - DNA, 25 bp, Artificial Sequence
  Corresponding array ID: crenarch_1_21
cctgcagcactgcattggccacaag

SEQ ID NO: 357 - DNA, 25 bp, Artificial Sequence
  Corresponding array ID: crenarch_1_22
ggcagcctgtacgttgagcgtacag

SEQ ID NO: 358 - DNA, 25 bp, Artificial Sequence
  Corresponding array ID: crenarch_1_23
tacgttgagcgtacagatttaaccg

SEQ ID NO: 359 - DNA, 25 bp, Artificial Sequence
  Corresponding array ID: crenarch_1_24
acgttgagcgtacagatttaaccga

SEQ ID NO: 360 - DNA, 25 bp, Artificial Sequence
  Corresponding array ID: crenarch_1_25
ccactccctagctctgcagtattcc

SEQ ID NO: 361 - DNA, 25 bp, Artificial Sequence
  Corresponding array ID: acido_1_1
tgcagcacctcttctggagtccccg

SEQ ID NO: 362 - DNA, 25 bp, Artificial Sequence
  Corresponding array ID: acido_1_2
gccggcagtccccccaaagtccccg

SEQ ID NO: 363 - DNA, 25 bp, Artificial Sequence
  Corresponding array ID: acido_1_3
ccatgcagcacctcttctggagtcc

SEQ ID NO: 364 - DNA, 25 bp, Artificial Sequence
  Corresponding array ID: acido_1_4
catgcagcacctcttctggagtccc

SEQ ID NO: 365 - DNA, 25 bp, Artificial Sequence
  Corresponding array ID: acido_1_5
gcgccggcagtccccccaaagtccc

SEQ ID NO: 366 - DNA, 25 bp, Artificial Sequence
  Corresponding array ID: acido_1_6
atgcagcacctcttctggagtcccc

SEQ ID NO: 367 - DNA, 25 bp, Artificial Sequence
  Corresponding array ID: acido_1_7
cgccggcagtccccccaaagtcccc

SEQ ID NO: 368 - DNA, 25 bp, Artificial Sequence
  Corresponding array ID: acido_1_8
gcagcacctcttctggagtccccga

SEQ ID NO: 369 - DNA, 25 bp, Artificial Sequence
  Corresponding array ID: acido_1_9
cagcacctcttctggagtccccgaa

SEQ ID NO: 370 - DNA, 25 bp, Artificial Sequence
  Corresponding array ID: acido_1_10
agcacctcttctggagtccccgaag

SEQ ID NO: 371 - DNA, 25 bp, Artificial Sequence
  Corresponding array ID: acido_1_11
ccggcagtccccccaaagtccccgg

SEQ ID NO: 372 - DNA, 25 bp, Artificial Sequence
  Corresponding array ID: acido_1_12
gcagtccccccaaagtccccggcat

SEQ ID NO: 373 - DNA, 25 bp, Artificial Sequence
  Corresponding array ID: acido_1_13
gcacctcttctggagtccccgaagg

SEQ ID NO: 374 - DNA, 25 bp, Artificial Sequence
  Corresponding array ID: acido_1_14
gccatgcagcacctcttctggagtc

SEQ ID NO: 375 - DNA, 25 bp, Artificial Sequence
  Corresponding array ID: acido_1_15
acctcttctggagtccccgaaggga

SEQ ID NO: 376 - DNA, 25 bp, Artificial Sequence
  Corresponding array ID: acido_1_16
cacctcttctggagtccccgaaggg

SEQ ID NO: 377 - DNA, 25 bp, Artificial Sequence
  Corresponding array ID: acido_1_17
cggcagtccccccaaagtccccggc

SEQ ID NO: 378 - DNA, 25 bp, Artificial Sequence
  Corresponding array ID: acido_1_18
ccccgaaggggccttaccgctcaac

SEQ ID NO: 379 - DNA, 25 bp, Artificial Sequence
  Corresponding array ID: acido_1_19
cctcttctggagtccccgaagggaa

SEQ ID NO: 380 - DNA, 25 bp, Artificial Sequence
  Corresponding array ID: acido_1_20
ggcagtccccccaaagtccccggca

SEQ ID NO: 381 - DNA, 25 bp, Artificial Sequence
  Corresponding array ID: acido_1_21
agccatgcagcacctcttctggagt

SEQ ID NO: 382 - DNA, 25 bp, Artificial Sequence
  Corresponding array ID: acido_1_22
cagccatgcagcacctcttctggag

SEQ ID NO: 383 - DNA, 25 bp, Artificial Sequence
  Corresponding array ID: acido_1_23
cccccgaaggggccttaccgctcaa

SEQ ID NO: 384 - DNA, 25 bp, Artificial Sequence
  Corresponding array ID: acido_1_24
acagccatgcagcacctcttctgga

SEQ ID NO: 385 - DNA, 25 bp, Artificial Sequence
  Corresponding array ID: acido_1_25
ccgaaggggccttaccgctcaactt

SEQ ID NO: 386 - DNA, 25 bp, Artificial Sequence
  Corresponding array ID: acido_2_1
gtcaactccctccacaccaagtgtt

SEQ ID NO: 387 - DNA, 25 bp, Artificial Sequence
  Corresponding array ID: acido_2_2
ggtcaactccctccacaccaagtgt

SEQ ID NO: 388 - DNA, 25 bp, Artificial Sequence
  Corresponding array ID: acido_2_3
gggtcaactccctccacaccaagtg

SEQ ID NO: 389 - DNA, 25 bp, Artificial Sequence
  Corresponding array ID: acido_2_4
tcaactccctccacaccaagtgttc

SEQ ID NO: 390 - DNA, 25 bp, Artificial Sequence
  Corresponding array ID: acido_2_5
ggggtcaactccctccacaccaagt

SEQ ID NO: 391 - DNA, 25 bp, Artificial Sequence
  Corresponding array ID: acido_2_6
aggggtcaactccctccacaccaag

SEQ ID NO: 392 - DNA, 25 bp, Artificial Sequence
  Corresponding array ID: acido_2_7
caactccctccacaccaagtgttca

SEQ ID NO: 393 - DNA, 25 bp, Artificial Sequence
  Corresponding array ID: acido_2_8
aaggggtcaactccctccacaccaa

SEQ ID NO: 394 - DNA, 25 bp, Artificial Sequence
  Corresponding array ID: acido_2_9
gaaggggtcaactccctccacacca

SEQ ID NO: 395 - DNA, 25 bp, Artificial Sequence
  Corresponding array ID: acido_2_10
aactccctccacaccaagtgttcat

SEQ ID NO: 396 - DNA, 25 bp, Artificial Sequence
  Corresponding array ID: acido_2_11
actccctccacaccaagtgttcatc

SEQ ID NO: 397 - DNA, 25 bp, Artificial Sequence
  Corresponding array ID: acido_2_12
ctccctccacaccaagtgttcatcg

SEQ ID NO: 398 - DNA, 25 bp, Artificial Sequence
  Corresponding array ID: acido_2_13
cagtccccgtagagttcccgccatg

SEQ ID NO: 399 - DNA, 25 bp, Artificial Sequence
  Corresponding array ID: acido_2_14
tccccgtagagttcccgccatgacg

SEQ ID NO: 400 - DNA, 25 bp, Artificial Sequence
  Corresponding array ID: acido_2_15
gtccccgtagagttcccgccatgac

SEQ ID NO: 401 - DNA, 25 bp, Artificial Sequence
  Corresponding array ID: acido_2_16
agtccccgtagagttcccgccatga

SEQ ID NO: 402 - DNA, 25 bp, Artificial Sequence
  Corresponding array ID: acido_2_17
gcagtccccgtagagttcccgccat

SEQ ID NO: 403 - DNA, 25 bp, Artificial Sequence
  Corresponding array ID: acido_2_18
ggcagtccccgtagagttcccgcca

SEQ ID NO: 404 - DNA, 25 bp, Artificial Sequence
  Corresponding array ID: acido_2_19
ccggcacggaaggggtcaactccct

SEQ ID NO: 405 - DNA, 25 bp, Artificial Sequence
  Corresponding array ID: acido_2_20
acgcgctggcaactacgggtaaggg

SEQ ID NO: 406 - DNA, 25 bp, Artificial Sequence
  Corresponding array ID: acido_2_21
gacgcgctggcaactacgggtaagg

SEQ ID NO: 407 - DNA, 25 bp, Artificial Sequence
  Corresponding array ID: acido_2_22
tgacgcgctggcaactacgggtaag

SEQ ID NO: 408 - DNA, 25 bp, Artificial Sequence
  Corresponding array ID: acido_2_23
agctccggcacggaaggggtcaact

SEQ ID NO: 409 - DNA, 25 bp, Artificial Sequence
  Corresponding array ID: acido_2_24
gctccggcacggaaggggtcaactc

SEQ ID NO: 410 - DNA, 25 bp, Artificial Sequence
  Corresponding array ID: acido_2_25
ctccggcacggaaggggtcaactcc

SEQ ID NO: 411 - DNA, 25 bp, Artificial Sequence
  Corresponding array ID: acido_3_1
ctcacggcattcgtcccactcgaca

SEQ ID NO: 412 - DNA, 25 bp, Artificial Sequence
  Corresponding array ID: acido_3_2
cgaggtccccacggtgtcatgcggt

SEQ ID NO: 413 - DNA, 25 bp, Artificial Sequence
  Corresponding array ID: acido_3_3
tcaccctcacggcattcgtcccact

SEQ ID NO: 414 - DNA, 25 bp, Artificial Sequence
  Corresponding array ID: acido_3_4
aggtccccacggtgtcatgcggtat

SEQ ID NO: 415 - DNA, 25 bp, Artificial Sequence
  Corresponding array ID: acido_3_5
ggaccgaggtccccacggtgtcatg

SEQ ID NO: 416 - DNA, 25 bp, Artificial Sequence
  Corresponding array ID: acido_3_6
ccgaggtccccacggtgtcatgcgg

SEQ ID NO: 417 - DNA, 25 bp, Artificial Sequence
  Corresponding array ID: acido_3_7
accctcacggcattcgtcccactcg

SEQ ID NO: 418 - DNA, 25 bp, Artificial Sequence
  Corresponding array ID: acido_3_8
accgaggtccccacggtgtcatgcg

SEQ ID NO: 419 - DNA, 25 bp, Artificial Sequence
  Corresponding array ID: acido_3_9
caccctcacggcattcgtcccactc

SEQ ID NO: 420 - DNA, 25 bp, Artificial Sequence
  Corresponding array ID: acido_3_10
gaccgaggtccccacggtgtcatgc

SEQ ID NO: 421 - DNA, 25 bp, Artificial Sequence
  Corresponding array ID: acido_3_11
cctcacggcattcgtcccactcgac

SEQ ID NO: 422 - DNA, 25 bp, Artificial Sequence
  Corresponding array ID: acido_3_12
ttcaccctcacggcattcgtcccac

SEQ ID NO: 423 - DNA, 25 bp, Artificial Sequence
  Corresponding array ID: acido_3_13
gaggtccccacggtgtcatgcggta

SEQ ID NO: 424 - DNA, 25 bp, Artificial Sequence
  Corresponding array ID: acido_3_14
ccctcacggcattcgtcccactcga

SEQ ID NO: 425 - DNA, 25 bp, Artificial Sequence
  Corresponding array ID: acido_3_15
ggtccccacggtgtcatgcggtatt

SEQ ID NO: 426 - DNA, 25 bp, Artificial Sequence
  Corresponding array ID: acido_3_16
gtccccacggtgtcatgcggtatta

SEQ ID NO: 427 - DNA, 25 bp, Artificial Sequence
  Corresponding array ID: acido_3_17
gattgttcaccctcacggcattcgt

SEQ ID NO: 428 - DNA, 25 bp, Artificial Sequence
  Corresponding array ID: acido_3_18
aggaccgaggtccccacggtgtcat

SEQ ID NO: 429 - DNA, 25 bp, Artificial Sequence
  Corresponding array ID: acido_3_19
attgttcaccctcacggcattcgtc

SEQ ID NO: 430 - DNA, 25 bp, Artificial Sequence
  Corresponding array ID: acido_3_20
ttgttcaccctcacggcattcgtcc

SEQ ID NO: 431 - DNA, 25 bp, Artificial Sequence
  Corresponding array ID: acido_3_21
tgttcaccctcacggcattcgtccc

SEQ ID NO: 432 - DNA, 25 bp, Artificial Sequence
  Corresponding array ID: acido_3_22
ggattgttcaccctcacggcattcg

SEQ ID NO: 433 - DNA, 25 bp, Artificial Sequence
  Corresponding array ID: acido_3_23
cacggcattcgtcccactcgacagg

SEQ ID NO: 434 - DNA, 25 bp, Artificial Sequence
  Corresponding array ID: acido_3_24
tcacggcattcgtcccactcgacag

SEQ ID NO: 435 - DNA, 25 bp, Artificial Sequence
  Corresponding array ID: acido_3_25
gctttgatcgcaaggaccgaggtcc

SEQ ID NO: 436 - DNA, 25 bp, Artificial Sequence
  Corresponding array ID: actino_1_1
aaacctagatccgtcatcccacacg

SEQ ID NO: 437 - DNA, 25 bp, Artificial Sequence
  Corresponding array ID: actino_1_2
caaacctagatccgtcatcccacac

SEQ ID NO: 438 - DNA, 25 bp, Artificial Sequence
  Corresponding array ID: actino_1_3
caccacctgtatagggcgctaatgc

SEQ ID NO: 439 - DNA, 25 bp, Artificial Sequence
  Corresponding array ID: actino_1_4
accacctgtatagggcgctaatgca

SEQ ID NO: 440 - DNA, 25 bp, Artificial Sequence
  Corresponding array ID: actino_1_5
ccacctgtatagggcgctaatgcac

SEQ ID NO: 441 - DNA, 25 bp, Artificial Sequence
  Corresponding array ID: actino_1_6
cacctgtatagggcgctaatgcaca

SEQ ID NO: 442 - DNA, 25 bp, Artificial Sequence
  Corresponding array ID: actino_1_7
gcaccacctgtatagggcgctaatg

SEQ ID NO: 443 - DNA, 25 bp, Artificial Sequence
  Corresponding array ID: actino_1_8
aacctagatccgtcatcccacacgc

SEQ ID NO: 444 - DNA, 25 bp, Artificial Sequence
  Corresponding array ID: actino_1_9
tgcaccacctgtatagggcgctaat

SEQ ID NO: 445 - DNA, 25 bp, Artificial Sequence
  Corresponding array ID: actino_1_10
agccctgaactttcacgaccgactt

SEQ ID NO: 446 - DNA, 25 bp, Artificial Sequence
  Corresponding array ID: actino_1_11
gccctgaactttcacgaccgacttg

SEQ ID NO: 447 - DNA, 25 bp, Artificial Sequence
  Corresponding array ID: actino_1_12
gagccctgaactttcacgaccgact

SEQ ID NO: 448 - DNA, 25 bp, Artificial Sequence
  Corresponding array ID: actino_1_13
agcgtcgatagcggcccagtgagct

SEQ ID NO: 449 - DNA, 25 bp, Artificial Sequence
  Corresponding array ID: actino_1_14
gcgtcgatagcggcccagtgagctg

SEQ ID NO: 450 - DNA, 25 bp, Artificial Sequence
  Corresponding array ID: actino_1_15
cgtcgatagcggcccagtgagctgc

SEQ ID NO: 451 - DNA, 25 bp, Artificial Sequence
  Corresponding array ID: actino_1_16
cagcgtcgatagcggcccagtgagc

SEQ ID NO: 452 - DNA, 25 bp, Artificial Sequence
  Corresponding array ID: actino_1_17
ccctgaactttcacgaccgacttgt

SEQ ID NO: 453 - DNA, 25 bp, Artificial Sequence
  Corresponding array ID: actino_1_18
tgagccctgaactttcacgaccgac

SEQ ID NO: 454 - DNA, 25 bp, Artificial Sequence
  Corresponding array ID: actino_1_19
acctagatccgtcatcccacacgcg

SEQ ID NO: 455 - DNA, 25 bp, Artificial Sequence
  Corresponding array ID: actino_1_20
ctcgggctatcccagtaactaaggt

SEQ ID NO: 456 - DNA, 25 bp, Artificial Sequence
  Corresponding array ID: actino_1_21
cctcgggctatcccagtaactaagg

SEQ ID NO: 457 - DNA, 25 bp, Artificial Sequence
  Corresponding array ID: actino_1_22
tcgatagcggcccagtgagctgcct

SEQ ID NO: 458 - DNA, 25 bp, Artificial Sequence
  Corresponding array ID: actino_1_23
gtcgatagcggcccagtgagctgcc

SEQ ID NO: 459 - DNA, 25 bp, Artificial Sequence
  Corresponding array ID: actino_1_24
cgatagcggcccagtgagctgcctt

SEQ ID NO: 460 - DNA, 25 bp, Artificial Sequence
  Corresponding array ID: actino_1_25
tcctcgggctatcccagtaactaag

SEQ ID NO: 461 - DNA, 25 bp, Artificial Sequence
  Corresponding array ID: actino_2_1
ccggtttccccaagtgcaagcactt

SEQ ID NO: 462 - DNA, 25 bp, Artificial Sequence
  Corresponding array ID: actino_2_2
caagcacttggttcgtccctcgact

SEQ ID NO: 463 - DNA, 25 bp, Artificial Sequence
  Corresponding array ID: actino_2_3
gccggtttccccaagtgcaagcact

SEQ ID NO: 464 - DNA, 25 bp, Artificial Sequence
  Corresponding array ID: actino_2_4
gcttcgacacggaaatcgtgaactg

SEQ ID NO: 465 - DNA, 25 bp, Artificial Sequence
  Corresponding array ID: actino_2_5
ttcgccggtttccccaagtgcaagc

SEQ ID NO: 466 - DNA, 25 bp, Artificial Sequence
  Corresponding array ID: actino_2_6
cgacacggaaatcgtgaactgatcc

SEQ ID NO: 467 - DNA, 25 bp, Artificial Sequence
  Corresponding array ID: actino_2_7
gacacggaaatcgtgaactgatccc

SEQ ID NO: 468 - DNA, 25 bp, Artificial Sequence
  Corresponding array ID: actino_2_8
acacggaaatcgtgaactgatcccc

SEQ ID NO: 469 - DNA, 25 bp, Artificial Sequence
  Corresponding array ID: actino_2_9
cgccggtttccccaagtgcaagcac

SEQ ID NO: 470 - DNA, 25 bp, Artificial Sequence
  Corresponding array ID: actino_2_10
acggaaatcgtgaactgatccccac

SEQ ID NO: 471 - DNA, 25 bp, Artificial Sequence
  Corresponding array ID: actino_2_11
tcgccggtttccccaagtgcaagca

SEQ ID NO: 472 - DNA, 25 bp, Artificial Sequence
  Corresponding array ID: actino_2_12
cacggaaatcgtgaactgatcccca

SEQ ID NO: 473 - DNA, 25 bp, Artificial Sequence
  Corresponding array ID: actino_2_13
cggtttccccaagtgcaagcacttg

SEQ ID NO: 474 - DNA, 25 bp, Artificial Sequence
  Corresponding array ID: actino_2_14
aagtgcaagcacttggttcgtccct

SEQ ID NO: 475 - DNA, 25 bp, Artificial Sequence
  Corresponding array ID: actino_2_15
gttcgccggtttccccaagtgcaag

SEQ ID NO: 476 - DNA, 25 bp, Artificial Sequence
  Corresponding array ID: actino_2_16
cggaaatcgtgaactgatccccaca

SEQ ID NO: 477 - DNA, 25 bp, Artificial Sequence
  Corresponding array ID: actino_2_17
gcaagcacttggttcgtccctcgac

SEQ ID NO: 478 - DNA, 25 bp, Artificial Sequence
  Corresponding array ID: actino_2_18
cgttcgccggtttccccaagtgcaa

SEQ ID NO: 479 - DNA, 25 bp, Artificial Sequence
  Corresponding array ID: actino_2_19
aagcacttggttcgtccctcgactt

SEQ ID NO: 480 - DNA, 25 bp, Artificial Sequence
  Corresponding array ID: actino_2_20
ggtttccccaagtgcaagcacttgg

SEQ ID NO: 481 - DNA, 25 bp, Artificial Sequence
  Corresponding array ID: actino_2_21
agtgcaagcacttggttcgtccctc

SEQ ID NO: 482 - DNA, 25 bp, Artificial Sequence
  Corresponding array ID: actino_2_22
caagtgcaagcacttggttcgtccc

SEQ ID NO: 483 - DNA, 25 bp, Artificial Sequence
  Corresponding array ID: actino_2_23
ccgttcgccggtttccccaagtgca

SEQ ID NO: 484 - DNA, 25 bp, Artificial Sequence
  Corresponding array ID: actino_2_24
ccgtagttatcccggtgtacagggc

SEQ ID NO: 485 - DNA, 25 bp, Artificial Sequence
  Corresponding array ID: actino_2_25
cctcaagccttgcagtatcgactgc

SEQ ID NO: 486 - DNA, 25 bp, Artificial Sequence
  Corresponding array ID: bacter_1_1
gtttccgcgactgtcattccacgtt

SEQ ID NO: 487 - DNA, 25 bp, Artificial Sequence
  Corresponding array ID: bacter_1_2
ttccgcgactgtcattccacgttcg

SEQ ID NO: 488 - DNA, 25 bp, Artificial Sequence
  Corresponding array ID: bacter_1_3
acgtttccgcgactgtcattccacg

SEQ ID NO: 489 - DNA, 25 bp, Artificial Sequence
  Corresponding array ID: bacter_1_4
tttccgcgactgtcattccacgttc

SEQ ID NO: 490 - DNA, 25 bp, Artificial Sequence
  Corresponding array ID: bacter_1_5
cacgtttccgcgactgtcattccac

SEQ ID NO: 491 - DNA, 25 bp, Artificial Sequence
  Corresponding array ID: bacter_1_6
tcacgtttccgcgactgtcattcca

SEQ ID NO: 492 - DNA, 25 bp, Artificial Sequence
  Corresponding array ID: bacter_1_7
cgtttccgcgactgtcattccacgt

SEQ ID NO: 493 - DNA, 25 bp, Artificial Sequence
  Corresponding array ID: bacter_1_8
tgtcattccacgttcgagcccaggt

SEQ ID NO: 494 - DNA, 25 bp, Artificial Sequence
  Corresponding array ID: bacter_1_9
ctgtcattccacgttcgagcccagg

SEQ ID NO: 495 - DNA, 25 bp, Artificial Sequence
  Corresponding array ID: bacter_1_10
ccgcgactgtcattccacgttcgag

SEQ ID NO: 496 - DNA, 25 bp, Artificial Sequence
  Corresponding array ID: bacter_1_11
actgtcattccacgttcgagcccag

SEQ ID NO: 497 - DNA, 25 bp, Artificial Sequence
  Corresponding array ID: bacter_1_12
cgcgactgtcattccacgttcgagc

SEQ ID NO: 498 - DNA, 25 bp, Artificial Sequence
  Corresponding array ID: bacter_1_13
gcgactgtcattccacgttcgagcc

SEQ ID NO: 499 - DNA, 25 bp, Artificial Sequence
  Corresponding array ID: bacter_1_14
cgactgtcattccacgttcgagccc

SEQ ID NO: 500 - DNA, 25 bp, Artificial Sequence
  Corresponding array ID: bacter_1_15
tccgcgactgtcattccacgttcga

SEQ ID NO: 501 - DNA, 25 bp, Artificial Sequence
  Corresponding array ID: bacter_1_16
gactgtcattccacgttcgagccca

SEQ ID NO: 502 - DNA, 25 bp, Artificial Sequence
  Corresponding array ID: bacter_1_17
atcacgtttccgcgactgtcattcc

SEQ ID NO: 503 - DNA, 25 bp, Artificial Sequence
  Corresponding array ID: bacter_1_18
gtcattccacgttcgagcccaggta

SEQ ID NO: 504 - DNA, 25 bp, Artificial Sequence
  Corresponding array ID: bacter_1_19
acggtaccatcagcaccgatacacg

SEQ ID NO: 505 - DNA, 25 bp, Artificial Sequence
  Corresponding array ID: bacter_1_20
gtaccatcagcaccgatacacgacc

SEQ ID NO: 506 - DNA, 25 bp, Artificial Sequence
  Corresponding array ID: bacter_1_21
ggtaccatcagcaccgatacacgac

SEQ ID NO: 507 - DNA, 25 bp, Artificial Sequence
  Corresponding array ID: bacter_1_22
cggtaccatcagcaccgatacacga

SEQ ID NO: 508 - DNA, 25 bp, Artificial Sequence
  Corresponding array ID: bacter_1_23
gatcacgtttccgcgactgtcattc

SEQ ID NO: 509 - DNA, 25 bp, Artificial Sequence
  Corresponding array ID: bacter_1_24
tacggtaccatcagcaccgatacac

SEQ ID NO: 510 - DNA, 25 bp, Artificial Sequence
  Corresponding array ID: bacter_1_25
caccgatacacgaccggtggttttt

SEQ ID NO: 511 - DNA, 25 bp, Artificial Sequence
  Corresponding array ID: bacter_2_1
ggatttctccgggctaccttccggt

SEQ ID NO: 512 - DNA, 25 bp, Artificial Sequence
  Corresponding array ID: bacter_2_2
ctccgggctaccttccggtaaaggg

SEQ ID NO: 513 - DNA, 25 bp, Artificial Sequence
  Corresponding array ID: bacter_2_3
cggatttctccgggctaccttccgg

SEQ ID NO: 514 - DNA, 25 bp, Artificial Sequence
  Corresponding array ID: bacter_2_4
tctccgggctaccttccggtaaagg

SEQ ID NO: 515 - DNA, 25 bp, Artificial Sequence
  Corresponding array ID: bacter_2_5
ttctccgggctaccttccggtaaag

SEQ ID NO: 516 - DNA, 25 bp, Artificial Sequence
  Corresponding array ID: bacter_2_6
tttctccgggctaccttccggtaaa

SEQ ID NO: 517 - DNA, 25 bp, Artificial Sequence
  Corresponding array ID: bacter_2_7
gatttctccgggctaccttccggta

SEQ ID NO: 518 - DNA, 25 bp, Artificial Sequence
  Corresponding array ID: bacter_2_8
atttctccgggctaccttccggtaa

SEQ ID NO: 519 - DNA, 25 bp, Artificial Sequence
  Corresponding array ID: bacter_2_9
ccggatttctccgggctaccttccg

SEQ ID NO: 520 - DNA, 25 bp, Artificial Sequence
  Corresponding array ID: bacter_2_10
tccggatttctccgggctaccttcc

SEQ ID NO: 521 - DNA, 25 bp, Artificial Sequence
  Corresponding array ID: bacter_2_11
tccgggctaccttccggtaaagggt

SEQ ID NO: 522 - DNA, 25 bp, Artificial Sequence
  Corresponding array ID: bacter_2_12
atccggatttctccgggctaccttc

SEQ ID NO: 523 - DNA, 25 bp, Artificial Sequence
  Corresponding array ID: bacter_2_13
ctttatggattagctccccgtcgct

SEQ ID NO: 524 - DNA, 25 bp, Artificial Sequence
  Corresponding array ID: bacter_2_14
actttatggattagctccccgtcgc

SEQ ID NO: 525 - DNA, 25 bp, Artificial Sequence
  Corresponding array ID: bacter_2_15
ccgggctaccttccggtaaagggta

SEQ ID NO: 526 - DNA, 25 bp, Artificial Sequence
  Corresponding array ID: bacter_2_16
aatccggatttctccgggctacctt

SEQ ID NO: 527 - DNA, 25 bp, Artificial Sequence
  Corresponding array ID: bacter_2_17
gctaccttccggtaaagggtaggtt

SEQ ID NO: 528 - DNA, 25 bp, Artificial Sequence
  Corresponding array ID: bacter_2_18
ggctaccttccggtaaagggtaggt

SEQ ID NO: 529 - DNA, 25 bp, Artificial Sequence
  Corresponding array ID: bacter_2_19
gggctaccttccggtaaagggtagg

SEQ ID NO: 530 - DNA, 25 bp, Artificial Sequence
  Corresponding array ID: bacter_2_20
taatccggatttctccgggctacct

SEQ ID NO: 531 - DNA, 25 bp, Artificial Sequence
  Corresponding array ID: bacter_2_21
ctaccttccggtaaagggtaggttg

SEQ ID NO: 532 - DNA, 25 bp, Artificial Sequence
  Corresponding array ID: bacter_2_22
cgggctaccttccggtaaagggtag

SEQ ID NO: 533 - DNA, 25 bp, Artificial Sequence
  Corresponding array ID: bacter_2_23
ttaatccggatttctccgggctacc

SEQ ID NO: 534 - DNA, 25 bp, Artificial Sequence
  Corresponding array ID: bacter_2_24
tttatggattagctccccgtcgctg

SEQ ID NO: 535 - DNA, 25 bp, Artificial Sequence
  Corresponding array ID: bacter_2_25
taccttccggtaaagggtaggttgc

SEQ ID NO: 536 - DNA, 25 bp, Artificial Sequence
  Corresponding array ID: bacter_3_1
ggctcctcgccgtatcatcgaaatt

SEQ ID NO: 537 - DNA, 25 bp, Artificial Sequence
  Corresponding array ID: bacter_3_2
caaccttgccaatcactccccaggt

SEQ ID NO: 538 - DNA, 25 bp, Artificial Sequence
  Corresponding array ID: bacter_3_3
cttgccaatcactccccaggtggat

SEQ ID NO: 539 - DNA, 25 bp, Artificial Sequence
  Corresponding array ID: bacter_3_4
caggtaaggctcctcgccgtatcat

SEQ ID NO: 540 - DNA, 25 bp, Artificial Sequence
  Corresponding array ID: bacter_3_5
aggctcctcgccgtatcatcgaaat

SEQ ID NO: 541 - DNA, 25 bp, Artificial Sequence
  Corresponding array ID: bacter_3_6
aaccttgccaatcactccccaggtg

SEQ ID NO: 542 - DNA, 25 bp, Artificial Sequence
  Corresponding array ID: bacter_3_7
accttgccaatcactccccaggtgg

SEQ ID NO: 543 - DNA, 25 bp, Artificial Sequence
  Corresponding array ID: bacter_3_8
tcaaccttgccaatcactccccagg

SEQ ID NO: 544 - DNA, 25 bp, Artificial Sequence
  Corresponding array ID: bacter_3_9
ggtaaggctcctcgccgtatcatcg

SEQ ID NO: 545 - DNA, 25 bp, Artificial Sequence
  Corresponding array ID: bacter_3_10
tccgcctaccccaactatactctag

SEQ ID NO: 546 - DNA, 25 bp, Artificial Sequence
  Corresponding array ID: bacter_3_11
ttcaaccttgccaatcactccccag

SEQ ID NO: 547 - DNA, 25 bp, Artificial Sequence
  Corresponding array ID: bacter_3_12
cccaggtaaggctcctcgccgtatc

SEQ ID NO: 548 - DNA, 25 bp, Artificial Sequence
  Corresponding array ID: bacter_3_13
aggtaaggctcctcgccgtatcatc

SEQ ID NO: 549 - DNA, 25 bp, Artificial Sequence
  Corresponding array ID: bacter_3_14
ccaatcactccccaggtggattacc

SEQ ID NO: 550 - DNA, 25 bp, Artificial Sequence
  Corresponding array ID: bacter_3_15
ccttgccaatcactccccaggtgga

SEQ ID NO: 551 - DNA, 25 bp, Artificial Sequence
  Corresponding array ID: bacter_3_16
gtaaggctcctcgccgtatcatcga

SEQ ID NO: 552 - DNA, 25 bp, Artificial Sequence
  Corresponding array ID: bacter_3_17
ccgcctaccccaactatactctaga

SEQ ID NO: 553 - DNA, 25 bp, Artificial Sequence
  Corresponding array ID: bacter_3_18
ccaggtaaggctcctcgccgtatca

SEQ ID NO: 554 - DNA, 25 bp, Artificial Sequence
  Corresponding array ID: bacter_3_19
aaggctcctcgccgtatcatcgaaa

SEQ ID NO: 555 - DNA, 25 bp, Artificial Sequence
  Corresponding array ID: bacter_3_20
gccaatcactccccaggtggattac

SEQ ID NO: 556 - DNA, 25 bp, Artificial Sequence
  Corresponding array ID: bacter_3_21
taaggctcctcgccgtatcatcgaa

SEQ ID NO: 557 - DNA, 25 bp, Artificial Sequence
  Corresponding array ID: bacter_3_22
gcccaggtaaggctcctcgccgtat

SEQ ID NO: 558 - DNA, 25 bp, Artificial Sequence
  Corresponding array ID: bacter_3_23
cattccgcctaccccaactatactc

SEQ ID NO: 559 - DNA, 25 bp, Artificial Sequence
  Corresponding array ID: bacter_3_24
caatcactccccaggtggattacct

SEQ ID NO: 560 - DNA, 25 bp, Artificial Sequence
  Corresponding array ID: bacter_3_25
ccgccggaactttgatcatcaagag

SEQ ID NO: 561 - DNA, 25 bp, Artificial Sequence
  Corresponding array ID: flavo_1_1
ctcagacaccaaggtccaaacagct

SEQ ID NO: 562 - DNA, 25 bp, Artificial Sequence
  Corresponding array ID: flavo_1_2
cagacaccaaggtccaaacagctag

SEQ ID NO: 563 - DNA, 25 bp, Artificial Sequence
  Corresponding array ID: flavo_1_3
cactcagacaccaaggtccaaacag

SEQ ID NO: 564 - DNA, 25 bp, Artificial Sequence
  Corresponding array ID: flavo_1_4
gcttagccactcagacaccaaggtc

SEQ ID NO: 565 - DNA, 25 bp, Artificial Sequence
  Corresponding array ID: flavo_1_5
actcagacaccaaggtccaaacagc

SEQ ID NO: 566 - DNA, 25 bp, Artificial Sequence
  Corresponding array ID: flavo_1_6
cttagccactcagacaccaaggtcc

SEQ ID NO: 567 - DNA, 25 bp, Artificial Sequence
  Corresponding array ID: flavo_1_7
taccgtcaagcttggtacacgtacc

SEQ ID NO: 568 - DNA, 25 bp, Artificial Sequence
  Corresponding array ID: flavo_1_8
gtaccgtcaagcttggtacacgtac

SEQ ID NO: 569 - DNA, 25 bp, Artificial Sequence
  Corresponding array ID: flavo_1_9
gccactcagacaccaaggtccaaac

SEQ ID NO: 570 - DNA, 25 bp, Artificial Sequence
  Corresponding array ID: flavo_1_10
ttagccactcagacaccaaggtcca

SEQ ID NO: 571 - DNA, 25 bp, Artificial Sequence
  Corresponding array ID: flavo_1_11
accgtcaagcttggtacacgtacca

SEQ ID NO: 572 - DNA, 25 bp, Artificial Sequence
  Corresponding array ID: flavo_1_12
ccactcagacaccaaggtccaaaca

SEQ ID NO: 573 - DNA, 25 bp, Artificial Sequence
  Corresponding array ID: flavo_1_13
agccactcagacaccaaggtccaaa

SEQ ID NO: 574 - DNA, 25 bp, Artificial Sequence
  Corresponding array ID: flavo_1_14
tagccactcagacaccaaggtccaa

SEQ ID NO: 575 - DNA, 25 bp, Artificial Sequence
  Corresponding array ID: flavo_1_15
ccgtcaagcttggtacacgtaccaa

SEQ ID NO: 576 - DNA, 25 bp, Artificial Sequence
  Corresponding array ID: flavo_1_16
cgcttagccactcagacaccaaggt

SEQ ID NO: 577 - DNA, 25 bp, Artificial Sequence
  Corresponding array ID: flavo_1_17
tcgcttagccactcagacaccaagg

SEQ ID NO: 578 - DNA, 25 bp, Artificial Sequence
  Corresponding array ID: flavo_1_18
cgtcaagcttggtacacgtaccaag

SEQ ID NO: 579 - DNA, 25 bp, Artificial Sequence
  Corresponding array ID: flavo_1_19
cagctagtaaccatcgtttaccggc

SEQ ID NO: 580 - DNA, 25 bp, Artificial Sequence
  Corresponding array ID: flavo_1_20
gccatagctagagactatgggggat

SEQ ID NO: 581 - DNA, 25 bp, Artificial Sequence
  Corresponding array ID: flavo_1_21
tgccatagctagagactatggggga

SEQ ID NO: 582 - DNA, 25 bp, Artificial Sequence
  Corresponding array ID: flavo_1_22
atgccatagctagagactatggggg

SEQ ID NO: 583 - DNA, 25 bp, Artificial Sequence
  Corresponding array ID: flavo_1_23
ttcgcttagccactcagacaccaag

SEQ ID NO: 584 - DNA, 25 bp, Artificial Sequence
  Corresponding array ID: flavo_1_24
agctagtaaccatcgtttaccggcg

SEQ ID NO: 585 - DNA, 25 bp, Artificial Sequence
  Corresponding array ID: flavo_1_25
gtcaagcttggtacacgtaccaagg

SEQ ID NO: 586 - DNA, 25 bp, Artificial Sequence
  Corresponding array ID: flavo_2_1
tacagtaccgtcagagctctacacg

SEQ ID NO: 587 - DNA, 25 bp, Artificial Sequence
  Corresponding array ID: flavo_2_2
tcttacagtaccgtcagagctctac

SEQ ID NO: 588 - DNA, 25 bp, Artificial Sequence
  Corresponding array ID: flavo_2_3
ttacagtaccgtcagagctctacac

SEQ ID NO: 589 - DNA, 25 bp, Artificial Sequence
  Corresponding array ID: flavo_2_4
gcatactcatctcttaccgccgaag

SEQ ID NO: 590 - DNA, 25 bp, Artificial Sequence
  Corresponding array ID: flavo_2_5
catactcatctcttaccgccgaagc

SEQ ID NO: 591 - DNA, 25 bp, Artificial Sequence
  Corresponding array ID: flavo_2_6
acagtaccgtcagagctctacacgt

SEQ ID NO: 592 - DNA, 25 bp, Artificial Sequence
  Corresponding array ID: flavo_2_7
cagtaccgtcagagctctacacgta

SEQ ID NO: 593 - DNA, 25 bp, Artificial Sequence
  Corresponding array ID: flavo_2_8
cttacagtaccgtcagagctctaca

SEQ ID NO: 594 - DNA, 25 bp, Artificial Sequence
  Corresponding array ID: flavo_2_9
tactcatctcttaccgccgaagctt

SEQ ID NO: 595 - DNA, 25 bp, Artificial Sequence
  Corresponding array ID: flavo_2_10
atactcatctcttaccgccgaagct

SEQ ID NO: 596 - DNA, 25 bp, Artificial Sequence
  Corresponding array ID: flavo_2_11
ctcatctcttaccgccgaagcttta

SEQ ID NO: 597 - DNA, 25 bp, Artificial Sequence
  Corresponding array ID: flavo_2_12
cgcccagtggctgctctctgtctat

SEQ ID NO: 598 - DNA, 25 bp, Artificial Sequence
  Corresponding array ID: flavo_2_13
ccagtggctgctctctgtctatacc

SEQ ID NO: 599 - DNA, 25 bp, Artificial Sequence
  Corresponding array ID: flavo_2_14
cccagtggctgctctctgtctatac

SEQ ID NO: 600 - DNA, 25 bp, Artificial Sequence
  Corresponding array ID: flavo_2_15
tcgcccagtggctgctctctgtcta

SEQ ID NO: 601 - DNA, 25 bp, Artificial Sequence
  Corresponding array ID: flavo_2_16
gcccagtggctgctctctgtctata

SEQ ID NO: 602 - DNA, 25 bp, Artificial Sequence
  Corresponding array ID: flavo_2_17
gactccgatccgaactgtgatatag

SEQ ID NO: 603 - DNA, 25 bp, Artificial Sequence
  Corresponding array ID: flavo_2_18
agaacgcatactcatctcttaccgc

SEQ ID NO: 604 - DNA, 25 bp, Artificial Sequence
  Corresponding array ID: flavo_2_19
gaacgcatactcatctcttaccgcc

SEQ ID NO: 605 - DNA, 25 bp, Artificial Sequence
  Corresponding array ID: flavo_2_20
cacgtagagcggtttcttcctgtat

SEQ ID NO: 606 - DNA, 25 bp, Artificial Sequence
  Corresponding array ID: flavo_2_21
gtcctgtcacactacatttaagccc

SEQ ID NO: 607 - DNA, 25 bp, Artificial Sequence
  Corresponding array ID: flavo_2_22
actcatctcttaccgccgaagcttt

SEQ ID NO: 608 - DNA, 25 bp, Artificial Sequence
  Corresponding array ID: flavo_2_23
cccctatctatcgtagccatggtgt

SEQ ID NO: 609 - DNA, 25 bp, Artificial Sequence
  Corresponding array ID: flavo_2_24
ccctatctatcgtagccatggtgtg

SEQ ID NO: 610 - DNA, 25 bp, Artificial Sequence
  Corresponding array ID: flavo_2_25
cctatctatcgtagccatggtgtgc

SEQ ID NO: 611 - DNA, 25 bp, Artificial Sequence
  Corresponding array ID: flavo_3_1
ctgtcacctaacatttaagccctgg

SEQ ID NO: 612 - DNA, 25 bp, Artificial Sequence
  Corresponding array ID: flavo_3_2
ccgtcaagctttctcacgagaaagt

SEQ ID NO: 613 - DNA, 25 bp, Artificial Sequence
  Corresponding array ID: flavo_3_3
accgtcaagctttctcacgagaaag

SEQ ID NO: 614 - DNA, 25 bp, Artificial Sequence
  Corresponding array ID: flavo_3_4
ctctgacttatttgtccacctacgg

SEQ ID NO: 615 - DNA, 25 bp, Artificial Sequence
  Corresponding array ID: flavo_3_5
cctctgacttatttgtccacctacg

SEQ ID NO: 616 - DNA, 25 bp, Artificial Sequence
  Corresponding array ID: flavo_3_6
gtaccgtcaagctttctcacgagaa

SEQ ID NO: 617 - DNA, 25 bp, Artificial Sequence
  Corresponding array ID: flavo_3_7
gaggcagattgtatacgcgatactc

SEQ ID NO: 618 - DNA, 25 bp, Artificial Sequence
  Corresponding array ID: flavo_3_8
tctatcgtagcctaggtgtgccgtt

SEQ ID NO: 619 - DNA, 25 bp, Artificial Sequence
  Corresponding array ID: flavo_3_9
cccctatctatcgtagcctaggtgt

SEQ ID NO: 620 - DNA, 25 bp, Artificial Sequence
  Corresponding array ID: flavo_3_10
atctatcgtagcctaggtgtgccgt

SEQ ID NO: 621 - DNA, 25 bp, Artificial Sequence
  Corresponding array ID: flavo_3_11
ccctatctatcgtagcctaggtgtg

SEQ ID NO: 622 - DNA, 25 bp, Artificial Sequence
  Corresponding array ID: flavo_3_12
tatctatcgtagcctaggtgtgccg

SEQ ID NO: 623 - DNA, 25 bp, Artificial Sequence
  Corresponding array ID: flavo_3_13
cctatctatcgtagcctaggtgtgc

SEQ ID NO: 624 - DNA, 25 bp, Artificial Sequence
  Corresponding array ID: flavo_3_14
ctatctatcgtagcctaggtgtgcc

SEQ ID NO: 625 - DNA, 25 bp, Artificial Sequence
  Corresponding array ID: flavo_3_15
ctatcgtagcctaggtgtgccgtta

SEQ ID NO: 626 - DNA, 25 bp, Artificial Sequence
  Corresponding array ID: flavo_3_16
tatcgtagcctaggtgtgccgttac

SEQ ID NO: 627 - DNA, 25 bp, Artificial Sequence
  Corresponding array ID: flavo_3_17
cttatttgtccacctacggaccctt

SEQ ID NO: 628 - DNA, 25 bp, Artificial Sequence
  Corresponding array ID: flavo_3_18
acttatttgtccacctacggaccct

SEQ ID NO: 629 - DNA, 25 bp, Artificial Sequence
  Corresponding array ID: flavo_3_19
gacttatttgtccacctacggaccc

SEQ ID NO: 630 - DNA, 25 bp, Artificial Sequence
  Corresponding array ID: flavo_3_20
tgacttatttgtccacctacggacc

SEQ ID NO: 631 - DNA, 25 bp, Artificial Sequence
  Corresponding array ID: flavo_3_21
ctgacttatttgtccacctacggac

SEQ ID NO: 632 - DNA, 25 bp, Artificial Sequence
  Corresponding array ID: flavo_3_22
agattgtatacgcgatactcacccg

SEQ ID NO: 633 - DNA, 25 bp, Artificial Sequence
  Corresponding array ID: flavo_3_23
gattgtatacgcgatactcacccgt

SEQ ID NO: 634 - DNA, 25 bp, Artificial Sequence
  Corresponding array ID: flavo_3_24
tcttcgggctattccctagtatgag

SEQ ID NO: 635 - DNA, 25 bp, Artificial Sequence
  Corresponding array ID: flavo_3_25
cttcgggctattccctagtatgagg

SEQ ID NO: 636 - DNA, 25 bp, Artificial Sequence
  Corresponding array ID: flavo_4_1
caggagatattcccatactatgggg

SEQ ID NO: 637 - DNA, 25 bp, Artificial Sequence
  Corresponding array ID: flavo_4_2
tcaaactcccacacgtgggagtggt

SEQ ID NO: 638 - DNA, 25 bp, Artificial Sequence
  Corresponding array ID: flavo_4_3
caaactcccacacgtgggagtggtt

SEQ ID NO: 639 - DNA, 25 bp, Artificial Sequence
  Corresponding array ID: flavo_4_4
gtcaaactcccacacgtgggagtgg

SEQ ID NO: 640 - DNA, 25 bp, Artificial Sequence
  Corresponding array ID: flavo_4_5
ggagatattcccatactatggggca

SEQ ID NO: 641 - DNA, 25 bp, Artificial Sequence
  Corresponding array ID: flavo_4_6
aggagatattcccatactatggggc

SEQ ID NO: 642 - DNA, 25 bp, Artificial Sequence
  Corresponding array ID: flavo_4_7
cgtcaaactcccacacgtgggagtg

SEQ ID NO: 643 - DNA, 25 bp, Artificial Sequence
  Corresponding array ID: flavo_4_8
aaactcccacacgtgggagtggttc

SEQ ID NO: 644 - DNA, 25 bp, Artificial Sequence
  Corresponding array ID: flavo_4_9
ctgggctattcccctccaaaaggta

SEQ ID NO: 645 - DNA, 25 bp, Artificial Sequence
  Corresponding array ID: flavo_4_10
ccgtcaaactcccacacgtgggagt

SEQ ID NO: 646 - DNA, 25 bp, Artificial Sequence
  Corresponding array ID: flavo_4_11
cttaaccactcagcccttaatcggg

SEQ ID NO: 647 - DNA, 25 bp, Artificial Sequence
  Corresponding array ID: flavo_4_12
gtttccctgggctattcccctccaa

SEQ ID NO: 648 - DNA, 25 bp, Artificial Sequence
  Corresponding array ID: flavo_4_13
gcttaaccactcagcccttaatcgg

SEQ ID NO: 649 - DNA, 25 bp, Artificial Sequence
  Corresponding array ID: flavo_4_14
aactcccacacgtgggagtggttct

SEQ ID NO: 650 - DNA, 25 bp, Artificial Sequence
  Corresponding array ID: flavo_4_15
accgtcaaactcccacacgtgggag

SEQ ID NO: 651 - DNA, 25 bp, Artificial Sequence
  Corresponding array ID: flavo_4_16
ccacacgtgggagtggttcttcctc

SEQ ID NO: 652 - DNA, 25 bp, Artificial Sequence
  Corresponding array ID: flavo_4_17
agtttccctgggctattcccctcca

SEQ ID NO: 653 - DNA, 25 bp, Artificial Sequence
  Corresponding array ID: flavo_4_18
ttaaccactcagcccttaatcgggc

SEQ ID NO: 654 - DNA, 25 bp, Artificial Sequence
  Corresponding array ID: flavo_4_19
cacgtgggagtggttcttcctctgt

SEQ ID NO: 655 - DNA, 25 bp, Artificial Sequence
  Corresponding array ID: flavo_4_20
cacacgtgggagtggttcttcctct

SEQ ID NO: 656 - DNA, 25 bp, Artificial Sequence
  Corresponding array ID: flavo_4_21
acacgtgggagtggttcttcctctg

SEQ ID NO: 657 - DNA, 25 bp, Artificial Sequence
  Corresponding array ID: flavo_4_22
cgcttaaccactcagcccttaatcg

SEQ ID NO: 658 - DNA, 25 bp, Artificial Sequence
  Corresponding array ID: flavo_4_23
acgtgggagtggttcttcctctgta

SEQ ID NO: 659 - DNA, 25 bp, Artificial Sequence
  Corresponding array ID: flavo_4_24
tttccctgggctattcccctccaaa

SEQ ID NO: 660 - DNA, 25 bp, Artificial Sequence
  Corresponding array ID: flavo_4_25
ttccctgggctattcccctccaaaa

SEQ ID NO: 661 - DNA, 25 bp, Artificial Sequence
  Corresponding array ID: flavo_5_1
cgtcaacagttcacacgtgaacctt

SEQ ID NO: 662 - DNA, 25 bp, Artificial Sequence
  Corresponding array ID: flavo_5_2
acagtaccgtcaacagttcacacgt

SEQ ID NO: 663 - DNA, 25 bp, Artificial Sequence
  Corresponding array ID: flavo_5_3
ccgtcaacagttcacacgtgaacct

SEQ ID NO: 664 - DNA, 25 bp, Artificial Sequence
  Corresponding array ID: flavo_5_4
cagtaccgtcaacagttcacacgtg

SEQ ID NO: 665 - DNA, 25 bp, Artificial Sequence
  Corresponding array ID: flavo_5_5
tacagtaccgtcaacagttcacacg

SEQ ID NO: 666 - DNA, 25 bp, Artificial Sequence
  Corresponding array ID: flavo_5_6
accgtcaacagttcacacgtgaacc

SEQ ID NO: 667 - DNA, 25 bp, Artificial Sequence
  Corresponding array ID: flavo_5_7
ctacagtaccgtcaacagttcacac

SEQ ID NO: 668 - DNA, 25 bp, Artificial Sequence
  Corresponding array ID: flavo_5_8
taccgtcaacagttcacacgtgaac

SEQ ID NO: 669 - DNA, 25 bp, Artificial Sequence
  Corresponding array ID: flavo_5_9
agtaccgtcaacagttcacacgtga

SEQ ID NO: 670 - DNA, 25 bp, Artificial Sequence
  Corresponding array ID: flavo_5_10
gtaccgtcaacagttcacacgtgaa

SEQ ID NO: 671 - DNA, 25 bp, Artificial Sequence
  Corresponding array ID: flavo_5_11
cctacagtaccgtcaacagttcaca

SEQ ID NO: 672 - DNA, 25 bp, Artificial Sequence
  Corresponding array ID: flavo_5_12
tcctacagtaccgtcaacagttcac

SEQ ID NO: 673 - DNA, 25 bp, Artificial Sequence
  Corresponding array ID: flavo_5_13
ccgaagaaaaagatgtttccacccc

SEQ ID NO: 674 - DNA, 25 bp, Artificial Sequence
  Corresponding array ID: flavo_5_14
ctcagaccgcaattagtccgaacag

SEQ ID NO: 675 - DNA, 25 bp, Artificial Sequence
  Corresponding array ID: flavo_5_15
tagccactcagaccgcaattagtcc

SEQ ID NO: 676 - DNA, 25 bp, Artificial Sequence
  Corresponding array ID: flavo_5_16
ttagccactcagaccgcaattagtc

SEQ ID NO: 677 - DNA, 25 bp, Artificial Sequence
  Corresponding array ID: flavo_5_17
actcagaccgcaattagtccgaaca

SEQ ID NO: 678 - DNA, 25 bp, Artificial Sequence
  Corresponding array ID: flavo_5_18
agatgtttccacccctgtcaaactg

SEQ ID NO: 679 - DNA, 25 bp, Artificial Sequence
  Corresponding array ID: flavo_5_19
cagaccgcaattagtccgaacagct

SEQ ID NO: 680 - DNA, 25 bp, Artificial Sequence
  Corresponding array ID: flavo_5_20
gccactcagaccgcaattagtccga

SEQ ID NO: 681 - DNA, 25 bp, Artificial Sequence
  Corresponding array ID: flavo_5_21
cactcagaccgcaattagtccgaac

SEQ ID NO: 682 - DNA, 25 bp, Artificial Sequence
  Corresponding array ID: flavo_5_22
cttagccactcagaccgcaattagt

SEQ ID NO: 683 - DNA, 25 bp, Artificial Sequence
  Corresponding array ID: flavo_5_23
agccactcagaccgcaattagtccg

SEQ ID NO: 684 - DNA, 25 bp, Artificial Sequence
  Corresponding array ID: flavo_5_24
tcagaccgcaattagtccgaacagc

SEQ ID NO: 685 - DNA, 25 bp, Artificial Sequence
  Corresponding array ID: flavo_5_25
actttcgcttagccactcagaccgc

SEQ ID NO: 686 - DNA, 25 bp, Artificial Sequence
  Corresponding array ID: flavo_6_1
agtgccggagttaagcccctgcatt

SEQ ID NO: 687 - DNA, 25 bp, Artificial Sequence
  Corresponding array ID: flavo_6_2
gtgccggagttaagcccctgcattt

SEQ ID NO: 688 - DNA, 25 bp, Artificial Sequence
  Corresponding array ID: flavo_6_3
cagtgccggagttaagcccctgcat

SEQ ID NO: 689 - DNA, 25 bp, Artificial Sequence
  Corresponding array ID: flavo_6_4
tgccggagttaagcccctgcatttc

SEQ ID NO: 690 - DNA, 25 bp, Artificial Sequence
  Corresponding array ID: flavo_6_5
agttaagcccctgcatttcaccact

SEQ ID NO: 691 - DNA, 25 bp, Artificial Sequence
  Corresponding array ID: flavo_6_6
gcagtgccggagttaagcccctgca

SEQ ID NO: 692 - DNA, 25 bp, Artificial Sequence
  Corresponding array ID: flavo_6_7
gttaagcccctgcatttcaccactg

SEQ ID NO: 693 - DNA, 25 bp, Artificial Sequence
  Corresponding array ID: flavo_6_8
ggcagtgccggagttaagcccctgc

SEQ ID NO: 694 - DNA, 25 bp, Artificial Sequence
  Corresponding array ID: flavo_6_9
tggcagtgccggagttaagcccctg

SEQ ID NO: 695 - DNA, 25 bp, Artificial Sequence
  Corresponding array ID: flavo_6_10
gagttaagcccctgcatttcaccac

SEQ ID NO: 696 - DNA, 25 bp, Artificial Sequence
  Corresponding array ID: flavo_6_11
gccggagttaagcccctgcatttca

SEQ ID NO: 697 - DNA, 25 bp, Artificial Sequence
  Corresponding array ID: flavo_6_12
atggcagtgccggagttaagcccct

SEQ ID NO: 698 - DNA, 25 bp, Artificial Sequence
  Corresponding array ID: flavo_6_13
ttaagcccctgcatttcaccactga

SEQ ID NO: 699 - DNA, 25 bp, Artificial Sequence
  Corresponding array ID: flavo_6_14
ggagttaagcccctgcatttcacca

SEQ ID NO: 700 - DNA, 25 bp, Artificial Sequence
  Corresponding array ID: flavo_6_15
cggagttaagcccctgcatttcacc

SEQ ID NO: 701 - DNA, 25 bp, Artificial Sequence
  Corresponding array ID: flavo_6_16
ccctgcatttcaccactgacttatc

SEQ ID NO: 702 - DNA, 25 bp, Artificial Sequence
  Corresponding array ID: flavo_6_17
caatggcagtgccggagttaagccc

SEQ ID NO: 703 - DNA, 25 bp, Artificial Sequence
  Corresponding array ID: flavo_6_18
tcaatggcagtgccggagttaagcc

SEQ ID NO: 704 - DNA, 25 bp, Artificial Sequence
  Corresponding array ID: flavo_6_19
ccttacggtcaccgacttcaggcac

SEQ ID NO: 705 - DNA, 25 bp, Artificial Sequence
  Corresponding array ID: flavo_6_20
ccggagttaagcccctgcatttcac

SEQ ID NO: 706 - DNA, 25 bp, Artificial Sequence
  Corresponding array ID: flavo_6_21
aatggcagtgccggagttaagcccc

SEQ ID NO: 707 - DNA, 25 bp, Artificial Sequence
  Corresponding array ID: flavo_6_22
tatcaatggcagtgccggagttaag

SEQ ID NO: 708 - DNA, 25 bp, Artificial Sequence
  Corresponding array ID: flavo_6_23
gtatcaatggcagtgccggagttaa

SEQ ID NO: 709 - DNA, 25 bp, Artificial Sequence
  Corresponding array ID: flavo_6_24
cccctgcatttcaccactgacttat

SEQ ID NO: 710 - DNA, 25 bp, Artificial Sequence
  Corresponding array ID: flavo_6_25
taagcccctgcatttcaccactgac

SEQ ID NO: 711 - DNA, 25 bp, Artificial Sequence
  Corresponding array ID: flavo_7_1
tcttacagtaccgtcaccagactac

SEQ ID NO: 712 - DNA, 25 bp, Artificial Sequence
  Corresponding array ID: flavo_7_2
cttacagtaccgtcaccagactaca

SEQ ID NO: 713 - DNA, 25 bp, Artificial Sequence
  Corresponding array ID: flavo_7_3
cgtcaccagactacacgtagtcctt

SEQ ID NO: 714 - DNA, 25 bp, Artificial Sequence
  Corresponding array ID: flavo_7_4
gtaccgtcaccagactacacgtagt

SEQ ID NO: 715 - DNA, 25 bp, Artificial Sequence
  Corresponding array ID: flavo_7_5
ccgtcaccagactacacgtagtcct

SEQ ID NO: 716 - DNA, 25 bp, Artificial Sequence
  Corresponding array ID: flavo_7_6
taccgtcaccagactacacgtagtc

SEQ ID NO: 717 - DNA, 25 bp, Artificial Sequence
  Corresponding array ID: flavo_7_7
accgtcaccagactacacgtagtcc

SEQ ID NO: 718 - DNA, 25 bp, Artificial Sequence
  Corresponding array ID: flavo_7_8
ttacagtaccgtcaccagactacac

SEQ ID NO: 719 - DNA, 25 bp, Artificial Sequence
  Corresponding array ID: flavo_7_9
gtcaccagactacacgtagtcctta

SEQ ID NO: 720 - DNA, 25 bp, Artificial Sequence
  Corresponding array ID: flavo_7_10
tacagtaccgtcaccagactacacg

SEQ ID NO: 721 - DNA, 25 bp, Artificial Sequence
  Corresponding array ID: flavo_7_11
acagtaccgtcaccagactacacgt

SEQ ID NO: 722 - DNA, 25 bp, Artificial Sequence
  Corresponding array ID: flavo_7_12
aactttcacccctgacttaacagcc

SEQ ID NO: 723 - DNA, 25 bp, Artificial Sequence
  Corresponding array ID: flavo_7_13
cagtaccgtcaccagactacacgta

SEQ ID NO: 724 - DNA, 25 bp, Artificial Sequence
  Corresponding array ID: flavo_7_14
ccggtcgtcagcaagagcaagctcc

SEQ ID NO: 725 - DNA, 25 bp, Artificial Sequence
  Corresponding array ID: flavo_7_15
actttcacccctgacttaacagccc

SEQ ID NO: 726 - DNA, 25 bp, Artificial Sequence
  Corresponding array ID: flavo_7_16
ccctgacttaacagcccgcctacgg

SEQ ID NO: 727 - DNA, 25 bp, Artificial Sequence
  Corresponding array ID: flavo_7_17
tcgcttggccgctcagatcgaaatc

SEQ ID NO: 728 - DNA, 25 bp, Artificial Sequence
  Corresponding array ID: flavo_7_18
cgcttggccgctcagatcgaaatcc

SEQ ID NO: 729 - DNA, 25 bp, Artificial Sequence
  Corresponding array ID: flavo_7_19
ttcgcttggccgctcagatcgaaat

SEQ ID NO: 730 - DNA, 25 bp, Artificial Sequence
  Corresponding array ID: flavo_7_20
tttcgcttggccgctcagatcgaaa

SEQ ID NO: 731 - DNA, 25 bp, Artificial Sequence
  Corresponding array ID: flavo_7_21
gcttggccgctcagatcgaaatcca

SEQ ID NO: 732 - DNA, 25 bp, Artificial Sequence
  Corresponding array ID: flavo_7_22
cttggccgctcagatcgaaatccaa

SEQ ID NO: 733 - DNA, 25 bp, Artificial Sequence
  Corresponding array ID: flavo_7_23
ttggccgctcagatcgaaatccaaa

SEQ ID NO: 734 - DNA, 25 bp, Artificial Sequence
  Corresponding array ID: flavo_7_24
ggctatcccttagtgtaaggcagat

SEQ ID NO: 735 - DNA, 25 bp, Artificial Sequence
  Corresponding array ID: flavo_7_25
gggctatcccttagtgtaaggcaga

SEQ ID NO: 736 - DNA, 25 bp, Artificial Sequence
  Corresponding array ID: flavo_8_1
gccgaaatacggtactacggggcat

SEQ ID NO: 737 - DNA, 25 bp, Artificial Sequence
  Corresponding array ID: flavo_8_2
gatgccgaaatacggtactacgggg

SEQ ID NO: 738 - DNA, 25 bp, Artificial Sequence
  Corresponding array ID: flavo_8_3
atgccgaaatacggtactacggggc

SEQ ID NO: 739 - DNA, 25 bp, Artificial Sequence
  Corresponding array ID: flavo_8_4
tgccgaaatacggtactacggggca

SEQ ID NO: 740 - DNA, 25 bp, Artificial Sequence
  Corresponding array ID: flavo_8_5
accgtataacgatgccgaaatacgg

SEQ ID NO: 741 - DNA, 25 bp, Artificial Sequence
  Corresponding array ID: flavo_8_6
ccgtataacgatgccgaaatacggt

SEQ ID NO: 742 - DNA, 25 bp, Artificial Sequence
  Corresponding array ID: flavo_8_7
cgatgccgaaatacggtactacggg

SEQ ID NO: 743 - DNA, 25 bp, Artificial Sequence
  Corresponding array ID: flavo_8_8
ccgaaatacggtactacggggcatt

SEQ ID NO: 744 - DNA, 25 bp, Artificial Sequence
  Corresponding array ID: flavo_8_9
acgatgccgaaatacggtactacgg

SEQ ID NO: 745 - DNA, 25 bp, Artificial Sequence
  Corresponding array ID: flavo_8_10
aacgatgccgaaatacggtactacg

SEQ ID NO: 746 - DNA, 25 bp, Artificial Sequence
  Corresponding array ID: flavo_8_11
cgaaggaaaagtcatctctgaccct

SEQ ID NO: 747 - DNA, 25 bp, Artificial Sequence
  Corresponding array ID: flavo_8_12
cgaaatacggtactacggggcatta

SEQ ID NO: 748 - DNA, 25 bp, Artificial Sequence
  Corresponding array ID: flavo_8_13
ccgaaggaaaagtcatctctgaccc

SEQ ID NO: 749 - DNA, 25 bp, Artificial Sequence
  Corresponding array ID: flavo_8_14
gtcatctctgaccctgtcaatatgc

SEQ ID NO: 750 - DNA, 25 bp, Artificial Sequence
  Corresponding array ID: flavo_8_15
cccgaaggaaaagtcatctctgacc

SEQ ID NO: 751 - DNA, 25 bp, Artificial Sequence
  Corresponding array ID: flavo_8_16
tacaaggcaggttccatacgcggtg

SEQ ID NO: 752 - DNA, 25 bp, Artificial Sequence
  Corresponding array ID: flavo_8_17
ggctttaaccgtataacgatgccga

SEQ ID NO: 753 - DNA, 25 bp, Artificial Sequence
  Corresponding array ID: flavo_8_18
ctgggctattcccctgtacaaggca

SEQ ID NO: 754 - DNA, 25 bp, Artificial Sequence
  Corresponding array ID: flavo_8_19
gaaggaaaagtcatctctgaccctg

SEQ ID NO: 755 - DNA, 25 bp, Artificial Sequence
  Corresponding array ID: flavo_8_20
gcccgaaggaaaagtcatctctgac

SEQ ID NO: 756 - DNA, 25 bp, Artificial Sequence
  Corresponding array ID: flavo_8_21
gtacaaggcaggttccatacgcggt

SEQ ID NO: 757 - DNA, 25 bp, Artificial Sequence
  Corresponding array ID: flavo_8_22
tgtacaaggcaggttccatacgcgg

SEQ ID NO: 758 - DNA, 25 bp, Artificial Sequence
  Corresponding array ID: flavo_8_23
cctgggctattcccctgtacaaggc

SEQ ID NO: 759 - DNA, 25 bp, Artificial Sequence
  Corresponding array ID: flavo_8_24
acaaggcaggttccatacgcggtgc

SEQ ID NO: 760 - DNA, 25 bp, Artificial Sequence
  Corresponding array ID: flavo_8_25
ggcaggttccatacgcggtgcgcac

SEQ ID NO: 761 - DNA, 25 bp, Artificial Sequence
  Corresponding array ID: flavo_9_1
attccgcctacttcaatacaactca

SEQ ID NO: 762 - DNA, 25 bp, Artificial Sequence
  Corresponding array ID: flavo_9_2
ttccgcctacttcaatacaactcaa

SEQ ID NO: 763 - DNA, 25 bp, Artificial Sequence
  Corresponding array ID: flavo_9_3
tattccgcctacttcaatacaactc

SEQ ID NO: 764 - DNA, 25 bp, Artificial Sequence
  Corresponding array ID: flavo_9_4
tccgcctacttcaatacaactcaag

SEQ ID NO: 765 - DNA, 25 bp, Artificial Sequence
  Corresponding array ID: flavo_9_5
catattccgcctacttcaatacaac

SEQ ID NO: 766 - DNA, 25 bp, Artificial Sequence
  Corresponding array ID: flavo_9_6
ccgcctacttcaatacaactcaaga

SEQ ID NO: 767 - DNA, 25 bp, Artificial Sequence
  Corresponding array ID: flavo_9_7
cgcctacttcaatacaactcaagat

SEQ ID NO: 768 - DNA, 25 bp, Artificial Sequence
  Corresponding array ID: flavo_9_8
gaactcaaggtcccgaacagctagt

SEQ ID NO: 769 - DNA, 25 bp, Artificial Sequence
  Corresponding array ID: flavo_9_9
tcagaactcaaggtcccgaacagct

SEQ ID NO: 770 - DNA, 25 bp, Artificial Sequence
  Corresponding array ID: flavo_9_10
actcaaggtcccgaacagctagtat

SEQ ID NO: 771 - DNA, 25 bp, Artificial Sequence
  Corresponding array ID: flavo_9_11
gatgcctatcaataataccatgagg

SEQ ID NO: 772 - DNA, 25 bp, Artificial Sequence
  Corresponding array ID: flavo_9_12
agaactcaaggtcccgaacagctag

SEQ ID NO: 773 - DNA, 25 bp, Artificial Sequence
  Corresponding array ID: flavo_9_13
ctcaaggtcccgaacagctagtatc

SEQ ID NO: 774 - DNA, 25 bp, Artificial Sequence
  Corresponding array ID: flavo_9_14
aactcaaggtcccgaacagctagta

SEQ ID NO: 775 - DNA, 25 bp, Artificial Sequence
  Corresponding array ID: flavo_9_15
cagaactcaaggtcccgaacagcta

SEQ ID NO: 776 - DNA, 25 bp, Artificial Sequence
  Corresponding array ID: flavo_9_16
ctcagaactcaaggtcccgaacagc

SEQ ID NO: 777 - DNA, 25 bp, Artificial Sequence
  Corresponding array ID: flavo_9_17
tcaaggtcccgaacagctagtatcc

SEQ ID NO: 778 - DNA, 25 bp, Artificial Sequence
  Corresponding array ID: flavo_9_18
gctcagaactcaaggtcccgaacag

SEQ ID NO: 779 - DNA, 25 bp, Artificial Sequence
  Corresponding array ID: flavo_9_19
ctacatattccgcctacttcaatac

SEQ ID NO: 780 - DNA, 25 bp, Artificial Sequence
  Corresponding array ID: flavo_9_20
gcctacttcaatacaactcaagatg

SEQ ID NO: 781 - DNA, 25 bp, Artificial Sequence
  Corresponding array ID: flavo_9_21
tacacgtaaggcttattcttcctgt

SEQ ID NO: 782 - DNA, 25 bp, Artificial Sequence
  Corresponding array ID: flavo_9_22
cacgtaaggcttattcttcctgtat

SEQ ID NO: 783 - DNA, 25 bp, Artificial Sequence
  Corresponding array ID: flavo_9_23
acacgtaaggcttattcttcctgta

SEQ ID NO: 784 - DNA, 25 bp, Artificial Sequence
  Corresponding array ID: flavo_9_24
cttagccgctcagaactcaaggtcc

SEQ ID NO: 785 - DNA, 25 bp, Artificial Sequence
  Corresponding array ID: flavo_9_25
cgctcagaactcaaggtcccgaaca

SEQ ID NO: 786 - DNA, 25 bp, Artificial Sequence
  Corresponding array ID: flavo_10_1
cgcttagccactcatctaaccaatg

SEQ ID NO: 787 - DNA, 25 bp, Artificial Sequence
  Corresponding array ID: flavo_10_2
ctttcgcttagccactcatctaacc

SEQ ID NO: 788 - DNA, 25 bp, Artificial Sequence
  Corresponding array ID: flavo_10_3
acacgtcggagtgtttcttcctgta

SEQ ID NO: 789 - DNA, 25 bp, Artificial Sequence
  Corresponding array ID: flavo_10_4
cccgtgcgccactcgtcatctggtg

SEQ ID NO: 790 - DNA, 25 bp, Artificial Sequence
  Corresponding array ID: flavo_10_5
acccgtgcgccactcgtcatctggt

SEQ ID NO: 791 - DNA, 25 bp, Artificial Sequence
  Corresponding array ID: flavo_10_6
cacccgtgcgccactcgtcatctgg

SEQ ID NO: 792 - DNA, 25 bp, Artificial Sequence
  Corresponding array ID: flavo_10_7
tacaacccgtagggctttcatcctg

SEQ ID NO: 793 - DNA, 25 bp, Artificial Sequence
  Corresponding array ID: flavo_10_8
acaacccgtagggctttcatcctgc

SEQ ID NO: 794 - DNA, 25 bp, Artificial Sequence
  Corresponding array ID: flavo_10_9
aacccgtagggctttcatcctgcac

SEQ ID NO: 795 - DNA, 25 bp, Artificial Sequence
  Corresponding array ID: flavo_10_10
cagtttacaacccgtagggctttca

SEQ ID NO: 796 - DNA, 25 bp, Artificial Sequence
  Corresponding array ID: flavo_10_11
caacccgtagggctttcatcctgca

SEQ ID NO: 797 - DNA, 25 bp, Artificial Sequence
  Corresponding array ID: flavo_10_12
ttacaacccgtagggctttcatcct

SEQ ID NO: 798 - DNA, 25 bp, Artificial Sequence
  Corresponding array ID: flavo_10_13
agcagtttacaacccgtagggcttt

SEQ ID NO: 799 - DNA, 25 bp, Artificial Sequence
  Corresponding array ID: flavo_10_14
gcagtttacaacccgtagggctttc

SEQ ID NO: 800 - DNA, 25 bp, Artificial Sequence
  Corresponding array ID: flavo_10_15
aagcagtttacaacccgtagggctt

SEQ ID NO: 801 - DNA, 25 bp, Artificial Sequence
  Corresponding array ID: flavo_10_16
cacgtcggagtgtttcttcctgtat

SEQ ID NO: 802 - DNA, 25 bp, Artificial Sequence
  Corresponding array ID: flavo_10_17
tgcgccactcgtcatctggtgcaag

SEQ ID NO: 803 - DNA, 25 bp, Artificial Sequence
  Corresponding array ID: flavo_10_18
ccgtgcgccactcgtcatctggtgc

SEQ ID NO: 804 - DNA, 25 bp, Artificial Sequence
  Corresponding array ID: flavo_10_19
gcgccactcgtcatctggtgcaagc

SEQ ID NO: 805 - DNA, 25 bp, Artificial Sequence
  Corresponding array ID: flavo_10_20
cgtgcgccactcgtcatctggtgca

SEQ ID NO: 806 - DNA, 25 bp, Artificial Sequence
  Corresponding array ID: flavo_10_21
gtgcgccactcgtcatctggtgcaa

SEQ ID NO: 807 - DNA, 25 bp, Artificial Sequence
  Corresponding array ID: flavo_10_22
gtttacaacccgtagggctttcatc

SEQ ID NO: 808 - DNA, 25 bp, Artificial Sequence
  Corresponding array ID: flavo_10_23
tttacaacccgtagggctttcatcc

SEQ ID NO: 809 - DNA, 25 bp, Artificial Sequence
  Corresponding array ID: flavo_10_24
gcacccgtgcgccactcgtcatctg

SEQ ID NO: 810 - DNA, 25 bp, Artificial Sequence
  Corresponding array ID: flavo_10_25
gcgaagtggctgctctctgtaccgg

SEQ ID NO: 811 - DNA, 25 bp, Artificial Sequence
  Corresponding array ID: flavo_11_1
gtacaagtactttatgctgcccctc

SEQ ID NO: 812 - DNA, 25 bp, Artificial Sequence
  Corresponding array ID: flavo_11_2
ccgccggagcttttcttaaaaactc

SEQ ID NO: 813 - DNA, 25 bp, Artificial Sequence
  Corresponding array ID: flavo_11_3
cggtcgccatcaaagtacaagtact

SEQ ID NO: 814 - DNA, 25 bp, Artificial Sequence
  Corresponding array ID: flavo_11_4
ccggtcgccatcaaagtacaagtac

SEQ ID NO: 815 - DNA, 25 bp, Artificial Sequence
  Corresponding array ID: flavo_11_5
cgtccctcagcgtcagttaattgtt

SEQ ID NO: 816 - DNA, 25 bp, Artificial Sequence
  Corresponding array ID: flavo_11_6
tacaagtactttatgctgcccctcg

SEQ ID NO: 817 - DNA, 25 bp, Artificial Sequence
  Corresponding array ID: flavo_11_7
cacgcggcatcgctggatcagagtt

SEQ ID NO: 818 - DNA, 25 bp, Artificial Sequence
  Corresponding array ID: flavo_11_8
tcgtccctcagcgtcagttaattgt

SEQ ID NO: 819 - DNA, 25 bp, Artificial Sequence
  Corresponding array ID: flavo_11_9
tcacgcggcatcgctggatcagagt

SEQ ID NO: 820 - DNA, 25 bp, Artificial Sequence
  Corresponding array ID: flavo_11_10
tgccagtatcaaaggcagttctacc

SEQ ID NO: 821 - DNA, 25 bp, Artificial Sequence
  Corresponding array ID: flavo_11_11
acaagtactttatgctgcccctcga

SEQ ID NO: 822 - DNA, 25 bp, Artificial Sequence
  Corresponding array ID: flavo_11_12
gtacatcgaacagctagtgaccatc

SEQ ID NO: 823 - DNA, 25 bp, Artificial Sequence
  Corresponding array ID: flavo_11_13
gccagtatcaaaggcagttctaccg

SEQ ID NO: 824 - DNA, 25 bp, Artificial Sequence
  Corresponding array ID: flavo_11_14
ttcgtccctcagcgtcagttaattg

SEQ ID NO: 825 - DNA, 25 bp, Artificial Sequence
  Corresponding array ID: flavo_11_15
caagtactttatgctgcccctcgac

SEQ ID NO: 826 - DNA, 25 bp, Artificial Sequence
  Corresponding array ID: flavo_11_16
cgccggtcgccatcaaagtacaagt

SEQ ID NO: 827 - DNA, 25 bp, Artificial Sequence
  Corresponding array ID: flavo_11_17
tcgccggtcgccatcaaagtacaag

SEQ ID NO: 828 - DNA, 25 bp, Artificial Sequence
  Corresponding array ID: flavo_11_18
gccggtcgccatcaaagtacaagta

SEQ ID NO: 829 - DNA, 25 bp, Artificial Sequence
  Corresponding array ID: flavo_11_19
ttcgccggtcgccatcaaagtacaa

SEQ ID NO: 830 - DNA, 25 bp, Artificial Sequence
  Corresponding array ID: flavo_11_20
cgttcgccggtcgccatcaaagtac

SEQ ID NO: 831 - DNA, 25 bp, Artificial Sequence
  Corresponding array ID: flavo_11_21
gttcgccggtcgccatcaaagtaca

SEQ ID NO: 832 - DNA, 25 bp, Artificial Sequence
  Corresponding array ID: flavo_11_22
tacctatcggagcttaggtgagccg

SEQ ID NO: 833 - DNA, 25 bp, Artificial Sequence
  Corresponding array ID: flavo_11_23
tatcggagcttaggtgagccgttac

SEQ ID NO: 834 - DNA, 25 bp, Artificial Sequence
  Corresponding array ID: flavo_11_24
ccctgacttaacaaacagcctgcgg

SEQ ID NO: 835 - DNA, 25 bp, Artificial Sequence
  Corresponding array ID: flavo_11_25
accgttgagcggtaggatttcaccc

SEQ ID NO: 836 - DNA, 25 bp, Artificial Sequence
  Corresponding array ID: flavo_12_1
cgtcttcctgcacgctgcatggctg

SEQ ID NO: 837 - DNA, 25 bp, Artificial Sequence
  Corresponding array ID: flavo_12_2
ccgtcttcctgcacgctgcatggct

SEQ ID NO: 838 - DNA, 25 bp, Artificial Sequence
  Corresponding array ID: flavo_12_3
gtcttcctgcacgctgcatggctgg

SEQ ID NO: 839 - DNA, 25 bp, Artificial Sequence
  Corresponding array ID: flavo_12_4
cttcctgcacgctgcatggctggat

SEQ ID NO: 840 - DNA, 25 bp, Artificial Sequence
  Corresponding array ID: flavo_12_5
ttcctgcacgctgcatggctggatc

SEQ ID NO: 841 - DNA, 25 bp, Artificial Sequence
  Corresponding array ID: flavo_12_6
gccgtcttcctgcacgctgcatggc

SEQ ID NO: 842 - DNA, 25 bp, Artificial Sequence
  Corresponding array ID: flavo_12_7
tcttcctgcacgctgcatggctgga

SEQ ID NO: 843 - DNA, 25 bp, Artificial Sequence
  Corresponding array ID: flavo_12_8
cacgctgcatggctggatcagagtt

SEQ ID NO: 844 - DNA, 25 bp, Artificial Sequence
  Corresponding array ID: flavo_12_9
ggccgtcttcctgcacgctgcatgg

SEQ ID NO: 845 - DNA, 25 bp, Artificial Sequence
  Corresponding array ID: flavo_12_10
tgcccaccttttaccaccggagttt

SEQ ID NO: 846 - DNA, 25 bp, Artificial Sequence
  Corresponding array ID: flavo_12_11
atgcccaccttttaccaccggagtt

SEQ ID NO: 847 - DNA, 25 bp, Artificial Sequence
  Corresponding array ID: flavo_12_12
cacacgtggacagatttcttcctgt

SEQ ID NO: 848 - DNA, 25 bp, Artificial Sequence
  Corresponding array ID: flavo_12_13
gaagactcgctcttcctcgcggagt

SEQ ID NO: 849 - DNA, 25 bp, Artificial Sequence
  Corresponding array ID: flavo_12_14
catgcccaccttttaccaccggagt

SEQ ID NO: 850 - DNA, 25 bp, Artificial Sequence
  Corresponding array ID: flavo_12_15
ccggctttgaagactcgctcttcct

SEQ ID NO: 851 - DNA, 25 bp, Artificial Sequence
  Corresponding array ID: flavo_12_16
ccacacgtggacagatttcttcctg

SEQ ID NO: 852 - DNA, 25 bp, Artificial Sequence
  Corresponding array ID: flavo_12_17
tttgaagactcgctcttcctcgcgg

SEQ ID NO: 853 - DNA, 25 bp, Artificial Sequence
  Corresponding array ID: flavo_12_18
ggctttgaagactcgctcttcctcg

SEQ ID NO: 854 - DNA, 25 bp, Artificial Sequence
  Corresponding array ID: flavo_12_19
ctttgaagactcgctcttcctcgcg

SEQ ID NO: 855 - DNA, 25 bp, Artificial Sequence
  Corresponding array ID: flavo_12_20
tgaagactcgctcttcctcgcggag

SEQ ID NO: 856 - DNA, 25 bp, Artificial Sequence
  Corresponding array ID: flavo_12_21
gaccggctttgaagactcgctcttc

SEQ ID NO: 857 - DNA, 25 bp, Artificial Sequence
  Corresponding array ID: flavo_12_22
cggctttgaagactcgctcttcctc

SEQ ID NO: 858 - DNA, 25 bp, Artificial Sequence
  Corresponding array ID: flavo_12_23
gctttgaagactcgctcttcctcgc

SEQ ID NO: 859 - DNA, 25 bp, Artificial Sequence
  Corresponding array ID: flavo_12_24
accggctttgaagactcgctcttcc

SEQ ID NO: 860 - DNA, 25 bp, Artificial Sequence
  Corresponding array ID: flavo_12_25
tcgtacagtaccgtcaactacccac

SEQ ID NO: 861 - DNA, 25 bp, Artificial Sequence
  Corresponding array ID: flavo_13_1
cgccggtcgtcagcatagcaagcta

SEQ ID NO: 862 - DNA, 25 bp, Artificial Sequence
  Corresponding array ID: flavo_13_2
aggtcgctcctcacggtaacgaact

SEQ ID NO: 863 - DNA, 25 bp, Artificial Sequence
  Corresponding array ID: flavo_13_3
ggtcgctcctcacggtaacgaactt

SEQ ID NO: 864 - DNA, 25 bp, Artificial Sequence
  Corresponding array ID: flavo_13_4
taggtcgctcctcacggtaacgaac

SEQ ID NO: 865 - DNA, 25 bp, Artificial Sequence
  Corresponding array ID: flavo_13_5
aggacgcatagtcatcttgtaccca

SEQ ID NO: 866 - DNA, 25 bp, Artificial Sequence
  Corresponding array ID: flavo_13_6
cctcacggtaacgaacttcaggcac

SEQ ID NO: 867 - DNA, 25 bp, Artificial Sequence
  Corresponding array ID: flavo_13_7
tcgcccagtggctgctcattgtcca

SEQ ID NO: 868 - DNA, 25 bp, Artificial Sequence
  Corresponding array ID: flavo_13_8
cgttcgccggtcgtcagcatagcaa

SEQ ID NO: 869 - DNA, 25 bp, Artificial Sequence
  Corresponding array ID: flavo_13_9
gtcgctcctcacggtaacgaacttc

SEQ ID NO: 870 - DNA, 25 bp, Artificial Sequence
  Corresponding array ID: flavo_13_10
gtcgcccagtggctgctcattgtcc

SEQ ID NO: 871 - DNA, 25 bp, Artificial Sequence
  Corresponding array ID: flavo_13_11
taggacgcatagtcatcttgtaccc

SEQ ID NO: 872 - DNA, 25 bp, Artificial Sequence
  Corresponding array ID: flavo_13_12
accagtatcaaaggcagttccatcg

SEQ ID NO: 873 - DNA, 25 bp, Artificial Sequence
  Corresponding array ID: flavo_13_13
tcctcacggtaacgaacttcaggca

SEQ ID NO: 874 - DNA, 25 bp, Artificial Sequence
  Corresponding array ID: flavo_13_14
ctaggtcgctcctcacggtaacgaa

SEQ ID NO: 875 - DNA, 25 bp, Artificial Sequence
  Corresponding array ID: flavo_13_15
ctcctcacggtaacgaacttcaggc

SEQ ID NO: 876 - DNA, 25 bp, Artificial Sequence
  Corresponding array ID: flavo_13_16
ccgttcgccggtcgtcagcatagca

SEQ ID NO: 877 - DNA, 25 bp, Artificial Sequence
  Corresponding array ID: flavo_13_17
gttcgccggtcgtcagcatagcaag

SEQ ID NO: 878 - DNA, 25 bp, Artificial Sequence
  Corresponding array ID: flavo_13_18
ctcacggtaacgaacttcaggcact

SEQ ID NO: 879 - DNA, 25 bp, Artificial Sequence
  Corresponding array ID: flavo_13_19
tcgctcctcacggtaacgaacttca

SEQ ID NO: 880 - DNA, 25 bp, Artificial Sequence
  Corresponding array ID: flavo_13_20
ggtcgcccagtggctgctcattgtc

SEQ ID NO: 881 - DNA, 25 bp, Artificial Sequence
  Corresponding array ID: flavo_13_21
cggcatagctggttcagagttgcct

SEQ ID NO: 882 - DNA, 25 bp, Artificial Sequence
  Corresponding array ID: flavo_13_22
ggcatagctggttcagagttgcctc

SEQ ID NO: 883 - DNA, 25 bp, Artificial Sequence
  Corresponding array ID: flavo_13_23
cgcggcatagctggttcagagttgc

SEQ ID NO: 884 - DNA, 25 bp, Artificial Sequence
  Corresponding array ID: flavo_13_24
gcggcatagctggttcagagttgcc

SEQ ID NO: 885 - DNA, 25 bp, Artificial Sequence
  Corresponding array ID: flavo_13_25
gcatagctggttcagagttgcctcc

SEQ ID NO: 886 - DNA, 25 bp, Artificial Sequence
  Corresponding array ID: flavo_14_1
gtgcaagcactcctgttacccctcg

SEQ ID NO: 887 - DNA, 25 bp, Artificial Sequence
  Corresponding array ID: flavo_14_2
agtgcaagcactcctgttacccctc

SEQ ID NO: 888 - DNA, 25 bp, Artificial Sequence
  Corresponding array ID: flavo_14_3
gcaagcactcctgttacccctcgac

SEQ ID NO: 889 - DNA, 25 bp, Artificial Sequence
  Corresponding array ID: flavo_14_4
tgcaagcactcctgttacccctcga

SEQ ID NO: 890 - DNA, 25 bp, Artificial Sequence
  Corresponding array ID: flavo_14_5
caagcactcctgttacccctcgact

SEQ ID NO: 891 - DNA, 25 bp, Artificial Sequence
  Corresponding array ID: flavo_14_6
aagcactcctgttacccctcgactt

SEQ ID NO: 892 - DNA, 25 bp, Artificial Sequence
  Corresponding array ID: flavo_14_7
agcactcctgttacccctcgacttg

SEQ ID NO: 893 - DNA, 25 bp, Artificial Sequence
  Corresponding array ID: flavo_14_8
gcactcctgttacccctcgacttgc

SEQ ID NO: 894 - DNA, 25 bp, Artificial Sequence
  Corresponding array ID: flavo_14_9
tgctacacgtagcagtgtttcttcc

SEQ ID NO: 895 - DNA, 25 bp, Artificial Sequence
  Corresponding array ID: flavo_14_10
cccgtgcgccggtcgtcagcgagtg

SEQ ID NO: 896 - DNA, 25 bp, Artificial Sequence
  Corresponding array ID: flavo_14_11
tcgtcagcgagtgcaagcactcctg

SEQ ID NO: 897 - DNA, 25 bp, Artificial Sequence
  Corresponding array ID: flavo_14_12
tgcgccggtcgtcagcgagtgcaag

SEQ ID NO: 898 - DNA, 25 bp, Artificial Sequence
  Corresponding array ID: flavo_14_13
cggtcgtcagcgagtgcaagcactc

SEQ ID NO: 899 - DNA, 25 bp, Artificial Sequence
  Corresponding array ID: flavo_14_14
ccgtgcgccggtcgtcagcgagtgc

SEQ ID NO: 900 - DNA, 25 bp, Artificial Sequence
  Corresponding array ID: flavo_14_15
gcgccggtcgtcagcgagtgcaagc

SEQ ID NO: 901 - DNA, 25 bp, Artificial Sequence
  Corresponding array ID: flavo_14_16
ggtcgtcagcgagtgcaagcactcc

SEQ ID NO: 902 - DNA, 25 bp, Artificial Sequence
  Corresponding array ID: flavo_14_17
gccggtcgtcagcgagtgcaagcac

SEQ ID NO: 903 - DNA, 25 bp, Artificial Sequence
  Corresponding array ID: flavo_14_18
gtcagcgagtgcaagcactcctgtt

SEQ ID NO: 904 - DNA, 25 bp, Artificial Sequence
  Corresponding array ID: flavo_14_19
ccggtcgtcagcgagtgcaagcact

SEQ ID NO: 905 - DNA, 25 bp, Artificial Sequence
  Corresponding array ID: flavo_14_20
tcagcgagtgcaagcactcctgtta

SEQ ID NO: 906 - DNA, 25 bp, Artificial Sequence
  Corresponding array ID: flavo_14_21
cgtgcgccggtcgtcagcgagtgca

SEQ ID NO: 907 - DNA, 25 bp, Artificial Sequence
  Corresponding array ID: flavo_14_22
cgccggtcgtcagcgagtgcaagca

SEQ ID NO: 908 - DNA, 25 bp, Artificial Sequence
  Corresponding array ID: flavo_14_23
gtgcgccggtcgtcagcgagtgcaa

SEQ ID NO: 909 - DNA, 25 bp, Artificial Sequence
  Corresponding array ID: flavo_14_24
cgtcagcgagtgcaagcactcctgt

SEQ ID NO: 910 - DNA, 25 bp, Artificial Sequence
  Corresponding array ID: flavo_14_25
gtcgtcagcgagtgcaagcactcct

SEQ ID NO: 911 - DNA, 25 bp, Artificial Sequence
  Corresponding array ID: flavo_15_1
ggcgtactccccaggtgcatcactt

SEQ ID NO: 912 - DNA, 25 bp, Artificial Sequence
  Corresponding array ID: flavo_15_2
ctccccaggtgcatcacttaatact

SEQ ID NO: 913 - DNA, 25 bp, Artificial Sequence
  Corresponding array ID: flavo_15_3
gcgtactccccaggtgcatcactta

SEQ ID NO: 914 - DNA, 25 bp, Artificial Sequence
  Corresponding array ID: flavo_15_4
cggcgtactccccaggtgcatcact

SEQ ID NO: 915 - DNA, 25 bp, Artificial Sequence
  Corresponding array ID: flavo_15_5
actccccaggtgcatcacttaatac

SEQ ID NO: 916 - DNA, 25 bp, Artificial Sequence
  Corresponding array ID: flavo_15_6
cgtactccccaggtgcatcacttaa

SEQ ID NO: 917 - DNA, 25 bp, Artificial Sequence
  Corresponding array ID: flavo_15_7
ccggcgtactccccaggtgcatcac

SEQ ID NO: 918 - DNA, 25 bp, Artificial Sequence
  Corresponding array ID: flavo_15_8
gtactccccaggtgcatcacttaat

SEQ ID NO: 919 - DNA, 25 bp, Artificial Sequence
  Corresponding array ID: flavo_15_9
gccggcgtactccccaggtgcatca

SEQ ID NO: 920 - DNA, 25 bp, Artificial Sequence
  Corresponding array ID: flavo_15_10
gaagagaaggcctgtttccaagccg

SEQ ID NO: 921 - DNA, 25 bp, Artificial Sequence
  Corresponding array ID: flavo_15_11
caacagcgagtgatgatcgtttacg

SEQ ID NO: 922 - DNA, 25 bp, Artificial Sequence
  Corresponding array ID: flavo_15_12
gcatgcccatctcataccgaaaaac

SEQ ID NO: 923 - DNA, 25 bp, Artificial Sequence
  Corresponding array ID: flavo_15_13
ttgtaatctgctccgaagagaaggc

SEQ ID NO: 924 - DNA, 25 bp, Artificial Sequence
  Corresponding array ID: flavo_15_14
cgccggtcgtcagcaaaagcaagct

SEQ ID NO: 925 - DNA, 25 bp, Artificial Sequence
  Corresponding array ID: flavo_15_15
aagagaaggcctgtttccaagccgg

SEQ ID NO: 926 - DNA, 25 bp, Artificial Sequence
  Corresponding array ID: flavo_15_16
gccggtcgtcagcaaaagcaagctt

SEQ ID NO: 927 - DNA, 25 bp, Artificial Sequence
  Corresponding array ID: flavo_15_17
tgccggcgtactccccaggtgcatc

SEQ ID NO: 928 - DNA, 25 bp, Artificial Sequence
  Corresponding array ID: flavo_15_18
gcgccggtcgtcagcaaaagcaagc

SEQ ID NO: 929 - DNA, 25 bp, Artificial Sequence
  Corresponding array ID: flavo_15_19
cgaagagaaggcctgtttccaagcc

SEQ ID NO: 930 - DNA, 25 bp, Artificial Sequence
  Corresponding array ID: flavo_15_20
ccaacagcgagtgatgatcgtttac

SEQ ID NO: 931 - DNA, 25 bp, Artificial Sequence
  Corresponding array ID: flavo_15_21
ggagtattaatccccgtttccaggg

SEQ ID NO: 932 - DNA, 25 bp, Artificial Sequence
  Corresponding array ID: flavo_15_22
tggagtattaatccccgtttccagg

SEQ ID NO: 933 - DNA, 25 bp, Artificial Sequence
  Corresponding array ID: flavo_15_23
tccccgtttccaggggctatcctcc

SEQ ID NO: 934 - DNA, 25 bp, Artificial Sequence
  Corresponding array ID: flavo_15_24
tgcgccggtcgtcagcaaaagcaag

SEQ ID NO: 935 - DNA, 25 bp, Artificial Sequence
  Corresponding array ID: flavo_15_25
aacagcgagtgatgatcgtttacgg

SEQ ID NO: 936 - DNA, 25 bp, Artificial Sequence
  Corresponding array ID: Vcholerae_1
aacttaaccaccttcctccctactg

SEQ ID NO: 937 - DNA, 25 bp, Artificial Sequence
  Corresponding array ID: Vcholerae_2
gtaggtaacgtcaaatgattaaggt

SEQ ID NO: 938 - DNA, 25 bp, Artificial Sequence
  Corresponding array ID: Vcholerae_3
tgtaggtaacgtcaaatgattaagg

SEQ ID NO: 939 - DNA, 25 bp, Artificial Sequence
  Corresponding array ID: Vcholerae_4
taacttaaccaccttcctccctact

SEQ ID NO: 940 - DNA, 25 bp, Artificial Sequence
  Corresponding array ID: Vcholerae_5
acttaaccaccttcctccctactga

SEQ ID NO: 941 - DNA, 25 bp, Artificial Sequence
  Corresponding array ID: Vcholerae_6
ttaacttaaccaccttcctccctac

SEQ ID NO: 942 - DNA, 25 bp, Artificial Sequence
  Corresponding array ID: Vcholerae_7
taaggtattaacttaaccaccttcc

SEQ ID NO: 943 - DNA, 25 bp, Artificial Sequence
  Corresponding array ID: Vcholerae_8
ctgtaggtaacgtcaaatgattaag

SEQ ID NO: 944 - DNA, 25 bp, Artificial Sequence
  Corresponding array ID: Vcholerae_9
cttaaccaccttcctccctactgaa

SEQ ID NO: 945 - DNA, 25 bp, Artificial Sequence
  Corresponding array ID: Vcholerae_10
attaacttaaccaccttcctcccta

SEQ ID NO: 946 - DNA, 25 bp, Artificial Sequence
  Corresponding array ID: Vcholerae_11
aaggtattaacttaaccaccttcct

SEQ ID NO: 947 - DNA, 25 bp, Artificial Sequence
  Corresponding array ID: Vcholerae_12
ttaaccaccttcctccctactgaaa

SEQ ID NO: 948 - DNA, 25 bp, Artificial Sequence
  Corresponding array ID: Vcholerae_13
cttctgtaggtaacgtcaaatgatt

SEQ ID NO: 949 - DNA, 25 bp, Artificial Sequence
  Corresponding array ID: Vcholerae_14
tattaacttaaccaccttcctccct

SEQ ID NO: 950 - DNA, 25 bp, Artificial Sequence
  Corresponding array ID: Vcholerae_15
acgacgtactttgtgagattcgctc

SEQ ID NO: 951 - DNA, 25 bp, Artificial Sequence
  Corresponding array ID: Vcholerae_16
tacgacgtactttgtgagattcgct

SEQ ID NO: 952 - DNA, 25 bp, Artificial Sequence
  Corresponding array ID: Vcholerae_17
actacgacgtactttgtgagattcg

SEQ ID NO: 953 - DNA, 25 bp, Artificial Sequence
  Corresponding array ID: Vcholerae_18
ctacgacgtactttgtgagattcgc

SEQ ID NO: 954 - DNA, 25 bp, Artificial Sequence
  Corresponding array ID: Vcholerae_19
gactacgacgtactttgtgagattc

SEQ ID NO: 955 - DNA, 25 bp, Artificial Sequence
  Corresponding array ID: Vcholerae_20
aggtattaacttaaccaccttcctc

SEQ ID NO: 956 - DNA, 25 bp, Artificial Sequence
  Corresponding array ID: Vcholerae_21
ggtattaacttaaccaccttcctcc

SEQ ID NO: 957 - DNA, 25 bp, Artificial Sequence
  Corresponding array ID: Vcholerae_22
gtattaacttaaccaccttcctccc

SEQ ID NO: 958 - DNA, 25 bp, Artificial Sequence
  Corresponding array ID: Vcholerae_23
cgcggtatcgctgccctctgtatac

SEQ ID NO: 959 - DNA, 25 bp, Artificial Sequence
  Corresponding array ID: Vcholerae_24
tcgcggtatcgctgccctctgtata

SEQ ID NO: 960 - DNA, 25 bp, Artificial Sequence
  Corresponding array ID: Vcholerae_25
cttgtcagtttcaaatgcgattcct

SEQ ID NO: 961 - DNA, 25 bp, Artificial Sequence
  Corresponding array ID: Vcholerae_26
ttgtcagtttcaaatgcgattccta

SEQ ID NO: 962 - DNA, 25 bp, Artificial Sequence
  Corresponding array ID: Vcholerae_27
gcggtatcgctgccctctgtatacg

SEQ ID NO: 963 - DNA, 25 bp, Artificial Sequence
  Corresponding array ID: Vcholerae_28
cctgggcatatccggtagcgcaagg

SEQ ID NO: 964 - DNA, 25 bp, Artificial Sequence
  Corresponding array ID: Vcholerae_29
tcccacctgggcatatccggtagcg

SEQ ID NO: 965 - DNA, 25 bp, Artificial Sequence
  Corresponding array ID: Vcholerae_30
ggcatatccggtagcgcaaggcccg

SEQ ID NO: 966 - DNA, 25 bp, Artificial Sequence
  Corresponding array ID: Vcholerae_31
acctgggcatatccggtagcgcaag

SEQ ID NO: 967 - DNA, 25 bp, Artificial Sequence
  Corresponding array ID: Vcholerae_32
ctgggcatatccggtagcgcaaggc

SEQ ID NO: 968 - DNA, 25 bp, Artificial Sequence
  Corresponding array ID: Vcholerae_33
cccacctgggcatatccggtagcgc

SEQ ID NO: 969 - DNA, 25 bp, Artificial Sequence
  Corresponding array ID: Vcholerae_34
tgggcatatccggtagcgcaaggcc

SEQ ID NO: 970 - DNA, 25 bp, Artificial Sequence
  Corresponding array ID: Vcholerae_35
gggcatatccggtagcgcaaggccc

SEQ ID NO: 971 - DNA, 25 bp, Artificial Sequence
  Corresponding array ID: Vcholerae_36
gcatatccggtagcgcaaggcccga

SEQ ID NO: 972 - DNA, 25 bp, Artificial Sequence
  Corresponding array ID: Vcholerae_37
ccacctgggcatatccggtagcgca

SEQ ID NO: 973 - DNA, 25 bp, Artificial Sequence
  Corresponding array ID: Vcholerae_38
catatccggtagcgcaaggcccgaa

SEQ ID NO: 974 - DNA, 25 bp, Artificial Sequence
  Corresponding array ID: Vcholerae_39
cacctgggcatatccggtagcgcaa

SEQ ID NO: 975 - DNA, 25 bp, Artificial Sequence
  Corresponding array ID: Vcholerae_40
atatccggtagcgcaaggcccgaag

SEQ ID NO: 976 - DNA, 25 bp, Artificial Sequence
  Corresponding array ID: Vcholerae_41
tatccggtagcgcaaggcccgaagg

SEQ ID NO: 977 - DNA, 25 bp, Artificial Sequence
  Corresponding array ID: Vcholerae_42
tcccctgctttgctcttgcgaggtt

SEQ ID NO: 978 - DNA, 25 bp, Artificial Sequence
  Corresponding array ID: Vcholerae_43
gtcccctgctttgctcttgcgaggt

SEQ ID NO: 979 - DNA, 25 bp, Artificial Sequence
  Corresponding array ID: Vcholerae_44
ccgaaggtcccctgctttgctcttg

SEQ ID NO: 980 - DNA, 25 bp, Artificial Sequence
  Corresponding array ID: Vcholerae_45
ggtcccctgctttgctcttgcgagg

SEQ ID NO: 981 - DNA, 25 bp, Artificial Sequence
  Corresponding array ID: Vcholerae_46
gaaggtcccctgctttgctcttgcg

SEQ ID NO: 982 - DNA, 25 bp, Artificial Sequence
  Corresponding array ID: Vcholerae_47
aggtcccctgctttgctcttgcgag

SEQ ID NO: 983 - DNA, 25 bp, Artificial Sequence
  Corresponding array ID: Vcholerae_48
cgaaggtcccctgctttgctcttgc

SEQ ID NO: 984 - DNA, 25 bp, Artificial Sequence
  Corresponding array ID: Vcholerae_49
aaggtcccctgctttgctcttgcga

SEQ ID NO: 985 - DNA, 25 bp, Artificial Sequence
  Corresponding array ID: Vcholerae_50
cccctgctttgctcttgcgaggtta

SEQ ID NO: 986 - DNA, 25 bp, Artificial Sequence
  Corresponding array ID: Vcholerae_51
tctagggcacaacctccaagtagac

SEQ ID NO: 987 - DNA, 25 bp, Artificial Sequence
  Corresponding array ID: Vcholerae_52
ctctagggcacaacctccaagtaga

SEQ ID NO: 988 - DNA, 25 bp, Artificial Sequence
  Corresponding array ID: Vcholerae_53
cctctagggcacaacctccaagtag

SEQ ID NO: 989 - DNA, 25 bp, Artificial Sequence
  Corresponding array ID: Vcholerae_54
cgacgtactttgtgagattcgctcc

SEQ ID NO: 990 - DNA, 25 bp, Artificial Sequence
  Corresponding array ID: Vcholerae_55
tcagtttcaaatgcgattcctaggt

SEQ ID NO: 991 - DNA, 25 bp, Artificial Sequence
  Corresponding array ID: Vcholerae_56
agtttcaaatgcgattcctaggttg

SEQ ID NO: 992 - DNA, 25 bp, Artificial Sequence
  Corresponding array ID: Vcholerae_57
tgtcagtttcaaatgcgattcctag

SEQ ID NO: 993 - DNA, 25 bp, Artificial Sequence
  Corresponding array ID: Vcholerae_58
gtttcaaatgcgattcctaggttga

SEQ ID NO: 994 - DNA, 25 bp, Artificial Sequence
  Corresponding array ID: Vcholerae_59
ctagcttgtcagtttcaaatgcgat

SEQ ID NO: 995 - DNA, 25 bp, Artificial Sequence
  Corresponding array ID: Vcholerae_60
tctagcttgtcagtttcaaatgcga

SEQ ID NO: 996 - DNA, 25 bp, Artificial Sequence
  Corresponding array ID: sphingo_1_1
ccagcttgctgccctctgtaccatc

SEQ ID NO: 997 - DNA, 25 bp, Artificial Sequence
  Corresponding array ID: sphingo_1_2
cagcttgctgccctctgtaccatcc

SEQ ID NO: 998 - DNA, 25 bp, Artificial Sequence
  Corresponding array ID: sphingo_1_3
gccagcttgctgccctctgtaccat

SEQ ID NO: 999 - DNA, 25 bp, Artificial Sequence
  Corresponding array ID: sphingo_1_4
tgccagcttgctgccctctgtacca

SEQ ID NO: 1000 - DNA, 25 bp, Artificial Sequence
  Corresponding array ID: sphingo_1_5
cagtttacgacccagagggctgtct

SEQ ID NO: 1001 - DNA, 25 bp, Artificial Sequence
  Corresponding array ID: sphingo_1_6
agcagtttacgacccagagggctgt

SEQ ID NO: 1002 - DNA, 25 bp, Artificial Sequence
  Corresponding array ID: sphingo_1_7
aagcagtttacgacccagagggctg

SEQ ID NO: 1003 - DNA, 25 bp, Artificial Sequence
  Corresponding array ID: sphingo_1_8
gcagtttacgacccagagggctgtc

SEQ ID NO: 1004 - DNA, 25 bp, Artificial Sequence
  Corresponding array ID: sphingo_1_9
ccgcctacctctagtgtattcaagc

SEQ ID NO: 1005 - DNA, 25 bp, Artificial Sequence
  Corresponding array ID: sphingo_1_10
cattccgcctacctctagtgtattc

SEQ ID NO: 1006 - DNA, 25 bp, Artificial Sequence
  Corresponding array ID: sphingo_1_11
tgctgttgccagcttgctgccctct

SEQ ID NO: 1007 - DNA, 25 bp, Artificial Sequence
  Corresponding array ID: sphingo_1_12
gctgttgccagcttgctgccctctg

SEQ ID NO: 1008 - DNA, 25 bp, Artificial Sequence
  Corresponding array ID: sphingo_1_13
ttgctgttgccagcttgctgccctc

SEQ ID NO: 1009 - DNA, 25 bp, Artificial Sequence
  Corresponding array ID: sphingo_1_14
cacattccgcctacctctagtgtat

SEQ ID NO: 1010 - DNA, 25 bp, Artificial Sequence
  Corresponding array ID: sphingo_1_15
gtcacattccgcctacctctagtgt

SEQ ID NO: 1011 - DNA, 25 bp, Artificial Sequence
  Corresponding array ID: sphingo_1_16
tcacattccgcctacctctagtgta

SEQ ID NO: 1012 - DNA, 25 bp, Artificial Sequence
  Corresponding array ID: sphingo_1_17
gctttcgcttagccgctaactgtgt

SEQ ID NO: 1013 - DNA, 25 bp, Artificial Sequence
  Corresponding array ID: sphingo_1_18
cgctttcgcttagccgctaactgtg

SEQ ID NO: 1014 - DNA, 25 bp, Artificial Sequence
  Corresponding array ID: sphingo_1_19
tcgcttagccgctaactgtgtatcg

SEQ ID NO: 1015 - DNA, 25 bp, Artificial Sequence
  Corresponding array ID: sphingo_1_20
ttcgcttagccgctaactgtgtatc

SEQ ID NO: 1016 - DNA, 25 bp, Artificial Sequence
  Corresponding array ID: sphingo_1_21
ctttcgcttagccgctaactgtgta

SEQ ID NO: 1017 - DNA, 25 bp, Artificial Sequence
  Corresponding array ID: sphingo_1_22
ctgttgccagcttgctgccctctgt

SEQ ID NO: 1018 - DNA, 25 bp, Artificial Sequence
  Corresponding array ID: sphingo_1_23
gttgccagcttgctgccctctgtac

SEQ ID NO: 1019 - DNA, 25 bp, Artificial Sequence
  Corresponding array ID: sphingo_1_24
tgttgccagcttgctgccctctgta

SEQ ID NO: 1020 - DNA, 25 bp, Artificial Sequence
  Corresponding array ID: sphingo_1_25
cgcttagccgctaactgtgtatcgc

SEQ ID NO: 1021 - DNA, 25 bp, Artificial Sequence
  Corresponding array ID: sphingo_2_1
tcaccgctacacccctcgttccgct

SEQ ID NO: 1022 - DNA, 25 bp, Artificial Sequence
  Corresponding array ID: sphingo_2_2
gctatcggcgttctgaggaatatct

SEQ ID NO: 1023 - DNA, 25 bp, Artificial Sequence
  Corresponding array ID: sphingo_2_3
cgctatcggcgttctgaggaatatc

SEQ ID NO: 1024 - DNA, 25 bp, Artificial Sequence
  Corresponding array ID: sphingo_2_4
tcggcgttctgaggaatatctatgc

SEQ ID NO: 1025 - DNA, 25 bp, Artificial Sequence
  Corresponding array ID: sphingo_2_5
ttcaccgctacacccctcgttccgc

SEQ ID NO: 1026 - DNA, 25 bp, Artificial Sequence
  Corresponding array ID: sphingo_2_6
tttcaccgctacacccctcgttccg

SEQ ID NO: 1027 - DNA, 25 bp, Artificial Sequence
  Corresponding array ID: sphingo_2_7
tcgctttcgcttagccacttactgt

SEQ ID NO: 1028 - DNA, 25 bp, Artificial Sequence
  Corresponding array ID: sphingo_2_8
cggcgttctgaggaatatctatgca

SEQ ID NO: 1029 - DNA, 25 bp, Artificial Sequence
  Corresponding array ID: sphingo_2_9
aactaatggggcgcatgcccatccc

SEQ ID NO: 1030 - DNA, 25 bp, Artificial Sequence
  Corresponding array ID: sphingo_2_10
cgcttagccacttactgtatatcgc

SEQ ID NO: 1031 - DNA, 25 bp, Artificial Sequence
  Corresponding array ID: sphingo_2_11
actaatggggcgcatgcccatcccg

SEQ ID NO: 1032 - DNA, 25 bp, Artificial Sequence
  Corresponding array ID: sphingo_2_12
gccatgcagcacctcgtatagagtc

SEQ ID NO: 1033 - DNA, 25 bp, Artificial Sequence
  Corresponding array ID: sphingo_2_13
agccatgcagcacctcgtatagagt

SEQ ID NO: 1034 - DNA, 25 bp, Artificial Sequence
  Corresponding array ID: sphingo_2_14
cagccatgcagcacctcgtatagag

SEQ ID NO: 1035 - DNA, 25 bp, Artificial Sequence
  Corresponding array ID: sphingo_2_15
acagccatgcagcacctcgtataga

SEQ ID NO: 1036 - DNA, 25 bp, Artificial Sequence
  Corresponding array ID: sphingo_2_16
cttacttgtcagcctacgcaccctt

SEQ ID NO: 1037 - DNA, 25 bp, Artificial Sequence
  Corresponding array ID: sphingo_2_17
acttacttgtcagcctacgcaccct

SEQ ID NO: 1038 - DNA, 25 bp, Artificial Sequence
  Corresponding array ID: sphingo_2_18
ccactgacttacttgtcagcctacg

SEQ ID NO: 1039 - DNA, 25 bp, Artificial Sequence
  Corresponding array ID: sphingo_2_19
cactgacttacttgtcagcctacgc

SEQ ID NO: 1040 - DNA, 25 bp, Artificial Sequence
  Corresponding array ID: sphingo_2_20
gacttacttgtcagcctacgcaccc

SEQ ID NO: 1041 - DNA, 25 bp, Artificial Sequence
  Corresponding array ID: sphingo_2_21
tgacttacttgtcagcctacgcacc

SEQ ID NO: 1042 - DNA, 25 bp, Artificial Sequence
  Corresponding array ID: sphingo_2_22
ctgacttacttgtcagcctacgcac

SEQ ID NO: 1043 - DNA, 25 bp, Artificial Sequence
  Corresponding array ID: sphingo_2_23
actgacttacttgtcagcctacgca

SEQ ID NO: 1044 - DNA, 25 bp, Artificial Sequence
  Corresponding array ID: sphingo_2_24
ccatgcagcacctcgtatagagtcc

SEQ ID NO: 1045 - DNA, 25 bp, Artificial Sequence
  Corresponding array ID: sphingo_2_25
cgctttcgcttagccacttactgta

SEQ ID NO: 1046 - DNA, 25 bp, Artificial Sequence
  Corresponding array ID: sphingo_3_1
agtttcctcgagctatgccccagtt

SEQ ID NO: 1047 - DNA, 25 bp, Artificial Sequence
  Corresponding array ID: sphingo_3_2
cgagtttcctcgagctatgccccag

SEQ ID NO: 1048 - DNA, 25 bp, Artificial Sequence
  Corresponding array ID: sphingo_3_3
gtttcctcgagctatgccccagtta

SEQ ID NO: 1049 - DNA, 25 bp, Artificial Sequence
  Corresponding array ID: sphingo_3_4
tttcctcgagctatgccccagttaa

SEQ ID NO: 1050 - DNA, 25 bp, Artificial Sequence
  Corresponding array ID: sphingo_3_5
gagtttcctcgagctatgccccagt

SEQ ID NO: 1051 - DNA, 25 bp, Artificial Sequence
  Corresponding array ID: sphingo_3_6
tcgagtttcctcgagctatgcccca

SEQ ID NO: 1052 - DNA, 25 bp, Artificial Sequence
  Corresponding array ID: sphingo_3_7
ttaccgaagtaaatgctgcccctcg

SEQ ID NO: 1053 - DNA, 25 bp, Artificial Sequence
  Corresponding array ID: sphingo_3_8
gttgctagctctaccctaaacagcg

SEQ ID NO: 1054 - DNA, 25 bp, Artificial Sequence
  Corresponding array ID: sphingo_3_9
agttgctagctctaccctaaacagc

SEQ ID NO: 1055 - DNA, 25 bp, Artificial Sequence
  Corresponding array ID: sphingo_3_10
ccatttaccgaagtaaatgctgccc

SEQ ID NO: 1056 - DNA, 25 bp, Artificial Sequence
  Corresponding array ID: sphingo_3_11
catttaccgaagtaaatgctgcccc

SEQ ID NO: 1057 - DNA, 25 bp, Artificial Sequence
  Corresponding array ID: sphingo_3_12
cgccatttaccgaagtaaatgctgc

SEQ ID NO: 1058 - DNA, 25 bp, Artificial Sequence
  Corresponding array ID: sphingo_3_13
ttgctagctctaccctaaacagcgc

SEQ ID NO: 1059 - DNA, 25 bp, Artificial Sequence
  Corresponding array ID: sphingo_3_14
gccatttaccgaagtaaatgctgcc

SEQ ID NO: 1060 - DNA, 25 bp, Artificial Sequence
  Corresponding array ID: sphingo_3_15
tcctcgagctatgccccagttaaag

SEQ ID NO: 1061 - DNA, 25 bp, Artificial Sequence
  Corresponding array ID: sphingo_3_16
ttcctcgagctatgccccagttaaa

SEQ ID NO: 1062 - DNA, 25 bp, Artificial Sequence
  Corresponding array ID: sphingo_3_17
cagttgctagctctaccctaaacag

SEQ ID NO: 1063 - DNA, 25 bp, Artificial Sequence
  Corresponding array ID: sphingo_3_18
tgctagctctaccctaaacagcgcc

SEQ ID NO: 1064 - DNA, 25 bp, Artificial Sequence
  Corresponding array ID: sphingo_3_19
ccgtcagatcctctcgcaagagtat

SEQ ID NO: 1065 - DNA, 25 bp, Artificial Sequence
  Corresponding array ID: sphingo_3_20
ctcgagctatgccccagttaaaggt

SEQ ID NO: 1066 - DNA, 25 bp, Artificial Sequence
  Corresponding array ID: sphingo_3_21
cctcgagctatgccccagttaaagg

SEQ ID NO: 1067 - DNA, 25 bp, Artificial Sequence
  Corresponding array ID: sphingo_3_22
ccagttgctagctctaccctaaaca

SEQ ID NO: 1068 - DNA, 25 bp, Artificial Sequence
  Corresponding array ID: sphingo_3_23
tctctctggatgtcactcgcattct

SEQ ID NO: 1069 - DNA, 25 bp, Artificial Sequence
  Corresponding array ID: sphingo_3_24
atctctctggatgtcactcgcattc

SEQ ID NO: 1070 - DNA, 25 bp, Artificial Sequence
  Corresponding array ID: sphingo_3_25
ctctctggatgtcactcgcattcta

SEQ ID NO: 1071 - DNA, 25 bp, Artificial Sequence
  Corresponding array ID: caldithrix_1_1
actcctcagagcttcatcgcccacg

SEQ ID NO: 1072 - DNA, 25 bp, Artificial Sequence
  Corresponding array ID: caldithrix_1_2
ctcctcagagcttcatcgcccacgc

SEQ ID NO: 1073 - DNA, 25 bp, Artificial Sequence
  Corresponding array ID: caldithrix_1_3
aacagggctttacactcctcagagc

SEQ ID NO: 1074 - DNA, 25 bp, Artificial Sequence
  Corresponding array ID: caldithrix_1_4
cactcctcagagcttcatcgcccac

SEQ ID NO: 1075 - DNA, 25 bp, Artificial Sequence
  Corresponding array ID: caldithrix_1_5
acagggctttacactcctcagagct

SEQ ID NO: 1076 - DNA, 25 bp, Artificial Sequence
  Corresponding array ID: caldithrix_1_6
acactcctcagagcttcatcgccca

SEQ ID NO: 1077 - DNA, 25 bp, Artificial Sequence
  Corresponding array ID: caldithrix_1_7
cagggctttacactcctcagagctt

SEQ ID NO: 1078 - DNA, 25 bp, Artificial Sequence
  Corresponding array ID: caldithrix_1_8
tcctcagagcttcatcgcccacgcg

SEQ ID NO: 1079 - DNA, 25 bp, Artificial Sequence
  Corresponding array ID: caldithrix_1_9
tacactcctcagagcttcatcgccc

SEQ ID NO: 1080 - DNA, 25 bp, Artificial Sequence
  Corresponding array ID: caldithrix_1_10
cttctggcactcccgactttcatgg

SEQ ID NO: 1081 - DNA, 25 bp, Artificial Sequence
  Corresponding array ID: caldithrix_1_11
ttacactcctcagagcttcatcgcc

SEQ ID NO: 1082 - DNA, 25 bp, Artificial Sequence
  Corresponding array ID: caldithrix_1_12
cctcagagcttcatcgcccacgcgg

SEQ ID NO: 1083 - DNA, 25 bp, Artificial Sequence
  Corresponding array ID: caldithrix_1_13
cctaacagggctttacactcctcag

SEQ ID NO: 1084 - DNA, 25 bp, Artificial Sequence
  Corresponding array ID: caldithrix_1_14
agggctttacactcctcagagcttc

SEQ ID NO: 1085 - DNA, 25 bp, Artificial Sequence
  Corresponding array ID: caldithrix_1_15
ttctggcactcccgactttcatggc

SEQ ID NO: 1086 - DNA, 25 bp, Artificial Sequence
  Corresponding array ID: caldithrix_1_16
tctggcactcccgactttcatggcg

SEQ ID NO: 1087 - DNA, 25 bp, Artificial Sequence
  Corresponding array ID: caldithrix_1_17
ctcagagcttcatcgcccacgcggc

SEQ ID NO: 1088 - DNA, 25 bp, Artificial Sequence
  Corresponding array ID: caldithrix_1_18
gggctttacactcctcagagcttca

SEQ ID NO: 1089 - DNA, 25 bp, Artificial Sequence
  Corresponding array ID: caldithrix_1_19
ctcctaacagggctttacactcctc

SEQ ID NO: 1090 - DNA, 25 bp, Artificial Sequence
  Corresponding array ID: caldithrix_1_20
ctggcactcccgactttcatggcgt

SEQ ID NO: 1091 - DNA, 25 bp, Artificial Sequence
  Corresponding array ID: caldithrix_1_21
tcagagcttcatcgcccacgcggcg

SEQ ID NO: 1092 - DNA, 25 bp, Artificial Sequence
  Corresponding array ID: caldithrix_1_22
acctctacagcagtcccgaaggaag

SEQ ID NO: 1093 - DNA, 25 bp, Artificial Sequence
  Corresponding array ID: caldithrix_1_23
ccctcctaacagggttttacactcc

SEQ ID NO: 1094 - DNA, 25 bp, Artificial Sequence
  Corresponding array ID: caldithrix_1_24
ggtcgaaacctccaacacctagtgc

SEQ ID NO: 1095 - DNA, 25 bp, Artificial Sequence
  Corresponding array ID: caldithrix_1_25
gtcgaaacctccaacacctagtgcc

SEQ ID NO: 1096 - DNA, 25 bp, Artificial Sequence
  Corresponding array ID: chloroflexi_1_1
tctccgaggagtcgttccagtttcc

SEQ ID NO: 1097 - DNA, 25 bp, Artificial Sequence
  Corresponding array ID: chloroflexi_1_2
ctccgaggagtcgttccagtttccc

SEQ ID NO: 1098 - DNA, 25 bp, Artificial Sequence
  Corresponding array ID: chloroflexi_1_3
acgaatgggtttgacaccacccaca

SEQ ID NO: 1099 - DNA, 25 bp, Artificial Sequence
  Corresponding array ID: chloroflexi_1_4
cgaatgggtttgacaccacccacac

SEQ ID NO: 1100 - DNA, 25 bp, Artificial Sequence
  Corresponding array ID: chloroflexi_1_5
ctctccgaggagtcgttccagtttc

SEQ ID NO: 1101 - DNA, 25 bp, Artificial Sequence
  Corresponding array ID: chloroflexi_1_6
tccgaggagtcgttccagtttccct

SEQ ID NO: 1102 - DNA, 25 bp, Artificial Sequence
  Corresponding array ID: chloroflexi_1_7
gaatgggtttgacaccacccacacc

SEQ ID NO: 1103 - DNA, 25 bp, Artificial Sequence
  Corresponding array ID: chloroflexi_1_8
gctctccgaggagtcgttccagttt

SEQ ID NO: 1104 - DNA, 25 bp, Artificial Sequence
  Corresponding array ID: chloroflexi_1_9
ccgaggagtcgttccagtttccctt

SEQ ID NO: 1105 - DNA, 25 bp, Artificial Sequence
  Corresponding array ID: chloroflexi_1_10
cgctctccgaggagtcgttccagtt

SEQ ID NO: 1106 - DNA, 25 bp, Artificial Sequence
  Corresponding array ID: chloroflexi_1_11
aatgggtttgacaccacccacacct

SEQ ID NO: 1107 - DNA, 25 bp, Artificial Sequence
  Corresponding array ID: chloroflexi_1_12
cgaggagtcgttccagtttcccttc

SEQ ID NO: 1108 - DNA, 25 bp, Artificial Sequence
  Corresponding array ID: chloroflexi_1_13
aggagtcgttccagtttcccttcac

SEQ ID NO: 1109 - DNA, 25 bp, Artificial Sequence
  Corresponding array ID: chloroflexi_1_14
gaggagtcgttccagtttcccttca

SEQ ID NO: 1110 - DNA, 25 bp, Artificial Sequence
  Corresponding array ID: chloroflexi_1_15
cgctttgcgacatgagcgtcaggtt

SEQ ID NO: 1111 - DNA, 25 bp, Artificial Sequence
  Corresponding array ID: chloroflexi_1_16
tgagcgtcaggttcaatgccagggt

SEQ ID NO: 1112 - DNA, 25 bp, Artificial Sequence
  Corresponding array ID: chloroflexi_1_17
acgctttgcgacatgagcgtcaggt

SEQ ID NO: 1113 - DNA, 25 bp, Artificial Sequence
  Corresponding array ID: chloroflexi_1_18
tccccacgctttgcgacatgagcgt

SEQ ID NO: 1114 - DNA, 25 bp, Artificial Sequence
  Corresponding array ID: chloroflexi_1_19
tcaggttcaatgccagggtaccgct

SEQ ID NO: 1115 - DNA, 25 bp, Artificial Sequence
  Corresponding array ID: chloroflexi_1_20
atcatctcggccttcacgttcgact

SEQ ID NO: 1116 - DNA, 25 bp, Artificial Sequence
  Corresponding array ID: chloroflexi_1_21
tgcgacatgagcgtcaggttcaatg

SEQ ID NO: 1117 - DNA, 25 bp, Artificial Sequence
  Corresponding array ID: chloroflexi_1_22
atgagcgtcaggttcaatgccaggg

SEQ ID NO: 1118 - DNA, 25 bp, Artificial Sequence
  Corresponding array ID: chloroflexi_1_23
cacgctttgcgacatgagcgtcagg

SEQ ID NO: 1119 - DNA, 25 bp, Artificial Sequence
  Corresponding array ID: chloroflexi_1_24
catgagcgtcaggttcaatgccagg

SEQ ID NO: 1120 - DNA, 25 bp, Artificial Sequence
  Corresponding array ID: chloroflexi_1_25
gtaatcatctcggccttcacgttcg

SEQ ID NO: 1121 - DNA, 25 bp, Artificial Sequence
  Corresponding array ID: chloroflexi_2_1
ggtgactcccctttcaggttgctac

SEQ ID NO: 1122 - DNA, 25 bp, Artificial Sequence
  Corresponding array ID: chloroflexi_2_2
aggtgactcccctttcaggttgcta

SEQ ID NO: 1123 - DNA, 25 bp, Artificial Sequence
  Corresponding array ID: chloroflexi_2_3
ccctccccattaagcggggagattt

SEQ ID NO: 1124 - DNA, 25 bp, Artificial Sequence
  Corresponding array ID: chloroflexi_2_4
gcaagcttggctcatcggtaccgtt

SEQ ID NO: 1125 - DNA, 25 bp, Artificial Sequence
  Corresponding array ID: chloroflexi_2_5
ctctcccgatgttccaagcaagctt

SEQ ID NO: 1126 - DNA, 25 bp, Artificial Sequence
  Corresponding array ID: chloroflexi_2_6
cccctccccattaagcggggagatt

SEQ ID NO: 1127 - DNA, 25 bp, Artificial Sequence
  Corresponding array ID: chloroflexi_2_7
ttccaagcaagcttggctcatcggt

SEQ ID NO: 1128 - DNA, 25 bp, Artificial Sequence
  Corresponding array ID: chloroflexi_2_8
agcaagcttggctcatcggtaccgt

SEQ ID NO: 1129 - DNA, 25 bp, Artificial Sequence
  Corresponding array ID: chloroflexi_2_9
actctcccgatgttccaagcaagct

SEQ ID NO: 1130 - DNA, 25 bp, Artificial Sequence
  Corresponding array ID: chloroflexi_2_10
acccctccccattaagcggggagat

SEQ ID NO: 1131 - DNA, 25 bp, Artificial Sequence
  Corresponding array ID: chloroflexi_2_11
tctcccgatgttccaagcaagcttg

SEQ ID NO: 1132 - DNA, 25 bp, Artificial Sequence
  Corresponding array ID: chloroflexi_2_12
ctcccgatgttccaagcaagcttgg

SEQ ID NO: 1133 - DNA, 25 bp, Artificial Sequence
  Corresponding array ID: chloroflexi_2_13
aatgacccctccccattaagcgggg

SEQ ID NO: 1134 - DNA, 25 bp, Artificial Sequence
  Corresponding array ID: chloroflexi_2_14
gaatgacccctccccattaagcggg

SEQ ID NO: 1135 - DNA, 25 bp, Artificial Sequence
  Corresponding array ID: chloroflexi_2_15
gttccaagcaagcttggctcatcgg

SEQ ID NO: 1136 - DNA, 25 bp, Artificial Sequence
  Corresponding array ID: chloroflexi_2_16
cgaatgacccctccccattaagcgg

SEQ ID NO: 1137 - DNA, 25 bp, Artificial Sequence
  Corresponding array ID: chloroflexi_2_17
tgttccaagcaagcttggctcatcg

SEQ ID NO: 1138 - DNA, 25 bp, Artificial Sequence
  Corresponding array ID: chloroflexi_2_18
tcgaatgacccctccccattaagcg

SEQ ID NO: 1139 - DNA, 25 bp, Artificial Sequence
  Corresponding array ID: chloroflexi_2_19
aagcaagcttggctcatcggtaccg

SEQ ID NO: 1140 - DNA, 25 bp, Artificial Sequence
  Corresponding array ID: chloroflexi_2_20
tgacccctccccattaagcggggag

SEQ ID NO: 1141 - DNA, 25 bp, Artificial Sequence
  Corresponding array ID: chloroflexi_2_21
ccactctcccgatgttccaagcaag

SEQ ID NO: 1142 - DNA, 25 bp, Artificial Sequence
  Corresponding array ID: chloroflexi_2_22
cctccccattaagcggggagatttc

SEQ ID NO: 1143 - DNA, 25 bp, Artificial Sequence
  Corresponding array ID: chloroflexi_2_23
caagcttggctcatcggtaccgttc

SEQ ID NO: 1144 - DNA, 25 bp, Artificial Sequence
  Corresponding array ID: chloroflexi_2_24
ccgatgttccaagcaagcttggctc

SEQ ID NO: 1145 - DNA, 25 bp, Artificial Sequence
  Corresponding array ID: chloroflexi_2_25
cactctcccgatgttccaagcaagc

SEQ ID NO: 1146 - DNA, 25 bp, Artificial Sequence
  Corresponding array ID: chlorella_pl_1
cgccactcatcgcaatctggcaagc

SEQ ID NO: 1147 - DNA, 25 bp, Artificial Sequence
  Corresponding array ID: chlorella_pl_2
gccactcatcgcaatctggcaagcc

SEQ ID NO: 1148 - DNA, 25 bp, Artificial Sequence
  Corresponding array ID: chlorella_pl_3
ccactcatcgcaatctggcaagcca

SEQ ID NO: 1149 - DNA, 25 bp, Artificial Sequence
  Corresponding array ID: chlorella_pl_4
cactcatcgcaatctggcaagccaa

SEQ ID NO: 1150 - DNA, 25 bp, Artificial Sequence
  Corresponding array ID: chlorella_pl_5
gcaagccaaattgcatgcgtacgac

SEQ ID NO: 1151 - DNA, 25 bp, Artificial Sequence
  Corresponding array ID: chlorella_pl_6
gccaaattgcatgcgtacgacttgc

SEQ ID NO: 1152 - DNA, 25 bp, Artificial Sequence
  Corresponding array ID: chlorella_pl_7
tggcaagccaaattgcatgcgtacg

SEQ ID NO: 1153 - DNA, 25 bp, Artificial Sequence
  Corresponding array ID: chlorella_pl_8
ctgtgtccactctggaacttcccct

SEQ ID NO: 1154 - DNA, 25 bp, Artificial Sequence
  Corresponding array ID: chlorella_pl_9
ccgtccgccactcatcgcaatctgg

SEQ ID NO: 1155 - DNA, 25 bp, Artificial Sequence
  Corresponding array ID: chlorella_pl_10
ccgccactcatcgcaatctggcaag

SEQ ID NO: 1156 - DNA, 25 bp, Artificial Sequence
  Corresponding array ID: chlorella_pl_11
cgtccgccactcatcgcaatctggc

SEQ ID NO: 1157 - DNA, 25 bp, Artificial Sequence
  Corresponding array ID: chlorella_pl_12
cctgtgtccactctggaacttcccc

SEQ ID NO: 1158 - DNA, 25 bp, Artificial Sequence
  Corresponding array ID: chlorella_pl_13
gtccgccactcatcgcaatctggca

SEQ ID NO: 1159 - DNA, 25 bp, Artificial Sequence
  Corresponding array ID: chlorella_pl_14
tccgccactcatcgcaatctggcaa

SEQ ID NO: 1160 - DNA, 25 bp, Artificial Sequence
  Corresponding array ID: chlorella_pl_15
acctgtgtccactctggaacttccc

SEQ ID NO: 1161 - DNA, 25 bp, Artificial Sequence
  Corresponding array ID: chlorella_pl_16
ggcaagccaaattgcatgcgtacga

SEQ ID NO: 1162 - DNA, 25 bp, Artificial Sequence
  Corresponding array ID: chlorella_pl_17
ctggcaagccaaattgcatgcgtac

SEQ ID NO: 1163 - DNA, 25 bp, Artificial Sequence
  Corresponding array ID: chlorella_pl_18
cccgtccgccactcatcgcaatctg

SEQ ID NO: 1164 - DNA, 25 bp, Artificial Sequence
  Corresponding array ID: chlorella_pl_19
cacctgtgtccactctggaacttcc

SEQ ID NO: 1165 - DNA, 25 bp, Artificial Sequence
  Corresponding array ID: chlorella_pl_20
acccgtccgccactcatcgcaatct

SEQ ID NO: 1166 - DNA, 25 bp, Artificial Sequence
  Corresponding array ID: chlorella_pl_21
ccacctgtgtccactctggaacttc

SEQ ID NO: 1167 - DNA, 25 bp, Artificial Sequence
  Corresponding array ID: chlorella_pl_22
cacccgtccgccactcatcgcaatc

SEQ ID NO: 1168 - DNA, 25 bp, Artificial Sequence
  Corresponding array ID: chlorella_pl_23
tcacccgtccgccactcatcgcaat

SEQ ID NO: 1169 - DNA, 25 bp, Artificial Sequence
  Corresponding array ID: chlorella_pl_24
accacctgtgtccactctggaactt

SEQ ID NO: 1170 - DNA, 25 bp, Artificial Sequence
  Corresponding array ID: chlorella_pl_25
caccacctgtgtccactctggaact

SEQ ID NO: 1171 - DNA, 25 bp, Artificial Sequence
  Corresponding array ID: plastid_1_1
ggtctcacgacttggcatctcattg

SEQ ID NO: 1172 - DNA, 25 bp, Artificial Sequence
  Corresponding array ID: plastid_1_2
tctccctaggcaggtttttgacctg

SEQ ID NO: 1173 - DNA, 25 bp, Artificial Sequence
  Corresponding array ID: plastid_1_3
ccacgtggattcgatacacgcaatg

SEQ ID NO: 1174 - DNA, 25 bp, Artificial Sequence
  Corresponding array ID: plastid_1_4
atgcaccacctgtatgtgtctgccg

SEQ ID NO: 1175 - DNA, 25 bp, Artificial Sequence
  Corresponding array ID: plastid_1_5
caccacctgtatgtgtctgccgaag

SEQ ID NO: 1176 - DNA, 25 bp, Artificial Sequence
  Corresponding array ID: plastid_1_6
aacaccacgtggattcgatacacgc

SEQ ID NO: 1177 - DNA, 25 bp, Artificial Sequence
  Corresponding array ID: plastid_1_7
accacctgtatgtgtctgccgaagc

SEQ ID NO: 1178 - DNA, 25 bp, Artificial Sequence
  Corresponding array ID: plastid_1_8
cttctccctaggcaggtttttgacc

SEQ ID NO: 1179 - DNA, 25 bp, Artificial Sequence
  Corresponding array ID: plastid_1_9
tgcaccacctgtatgtgtctgccga

SEQ ID NO: 1180 - DNA, 25 bp, Artificial Sequence
  Corresponding array ID: plastid_1_10
acaccacgtggattcgatacacgca

SEQ ID NO: 1181 - DNA, 25 bp, Artificial Sequence
  Corresponding array ID: plastid_1_11
ccacctgtatgtgtctgccgaagca

SEQ ID NO: 1182 - DNA, 25 bp, Artificial Sequence
  Corresponding array ID: plastid_1_12
gcaccacctgtatgtgtctgccgaa

SEQ ID NO: 1183 - DNA, 25 bp, Artificial Sequence
  Corresponding array ID: plastid_1_13
caccacgtggattcgatacacgcaa

SEQ ID NO: 1184 - DNA, 25 bp, Artificial Sequence
  Corresponding array ID: plastid_1_14
ctcacgacttggcatctcattgtcc

SEQ ID NO: 1185 - DNA, 25 bp, Artificial Sequence
  Corresponding array ID: plastid_1_15
caggtacacgtcagaaacttcctcc

SEQ ID NO: 1186 - DNA, 25 bp, Artificial Sequence
  Corresponding array ID: plastid_1_16
ctccctaggcaggtttttgacctgt

SEQ ID NO: 1187 - DNA, 25 bp, Artificial Sequence
  Corresponding array ID: plastid_1_17
cggtctcacgacttggcatctcatt

SEQ ID NO: 1188 - DNA, 25 bp, Artificial Sequence
  Corresponding array ID: plastid_1_18
gaccaactactgatcgtcaccttgg

SEQ ID NO: 1189 - DNA, 25 bp, Artificial Sequence
  Corresponding array ID: plastid_1_19
gcttctccctaggcaggtttttgac

SEQ ID NO: 1190 - DNA, 25 bp, Artificial Sequence
  Corresponding array ID: plastid_1_20
cacctgtatgtgtctgccgaagcac

SEQ ID NO: 1191 - DNA, 25 bp, Artificial Sequence
  Corresponding array ID: plastid_1_21
ctgtatgtgtctgccgaagcacttc

SEQ ID NO: 1192 - DNA, 25 bp, Artificial Sequence
  Corresponding array ID: plastid_1_22
catgcaccacctgtatgtgtctgcc

SEQ ID NO: 1193 - DNA, 25 bp, Artificial Sequence
  Corresponding array ID: plastid_1_23
aggtacacgtcagaaacttcctccc

SEQ ID NO: 1194 - DNA, 25 bp, Artificial Sequence
  Corresponding array ID: plastid_1_24
tcggtctcacgacttggcatctcat

SEQ ID NO: 1195 - DNA, 25 bp, Artificial Sequence
  Corresponding array ID: plastid_1_25
ccttctacttcgactctactcgagc

SEQ ID NO: 1196 - DNA, 25 bp, Artificial Sequence
  Corresponding array ID: plastid_2_1
caggtaacgtcagaacttcctccct

SEQ ID NO: 1197 - DNA, 25 bp, Artificial Sequence
  Corresponding array ID: plastid_2_2
aggtaacgtcagaacttcctccctg

SEQ ID NO: 1198 - DNA, 25 bp, Artificial Sequence
  Corresponding array ID: plastid_2_3
ggtaacgtcagaacttcctccctga

SEQ ID NO: 1199 - DNA, 25 bp, Artificial Sequence
  Corresponding array ID: plastid_2_4
tcaggtaacgtcagaacttcctccc

SEQ ID NO: 1200 - DNA, 25 bp, Artificial Sequence
  Corresponding array ID: plastid_2_5
cgcgttagctataataccgcatggg

SEQ ID NO: 1201 - DNA, 25 bp, Artificial Sequence
  Corresponding array ID: plastid_2_6
aataccgcatgggtcgatacatgcg

SEQ ID NO: 1202 - DNA, 25 bp, Artificial Sequence
  Corresponding array ID: plastid_2_7
ctgtatgtacgttcccgaaggtggt

SEQ ID NO: 1203 - DNA, 25 bp, Artificial Sequence
  Corresponding array ID: plastid_2_8
cctgtatgtacgttcccgaaggtgg

SEQ ID NO: 1204 - DNA, 25 bp, Artificial Sequence
  Corresponding array ID: plastid_2_9
tcagccgcgagctcctctctaggca

SEQ ID NO: 1205 - DNA, 25 bp, Artificial Sequence
  Corresponding array ID: plastid_2_10
ataccgcatgggtcgatacatgcga

SEQ ID NO: 1206 - DNA, 25 bp, Artificial Sequence
  Corresponding array ID: plastid_2_11
acctgtatgtacgttcccgaaggtg

SEQ ID NO: 1207 - DNA, 25 bp, Artificial Sequence
  Corresponding array ID: plastid_2_12
gccgcgagctcctctctaggcagaa

SEQ ID NO: 1208 - DNA, 25 bp, Artificial Sequence
  Corresponding array ID: plastid_2_13
gcgccttcctccaaacggttagaat

SEQ ID NO: 1209 - DNA, 25 bp, Artificial Sequence
  Corresponding array ID: plastid_2_14
agccgcgagctcctctctaggcaga

SEQ ID NO: 1210 - DNA, 25 bp, Artificial Sequence
  Corresponding array ID: plastid_2_15
cagccgcgagctcctctctaggcag

SEQ ID NO: 1211 - DNA, 25 bp, Artificial Sequence
  Corresponding array ID: plastid_2_16
cacctgtatgtacgttcccgaaggt

SEQ ID NO: 1212 - DNA, 25 bp, Artificial Sequence
  Corresponding array ID: plastid_2_17
aatcagccgcgagctcctctctagg

SEQ ID NO: 1213 - DNA, 25 bp, Artificial Sequence
  Corresponding array ID: plastid_2_18
taatcagccgcgagctcctctctag

SEQ ID NO: 1214 - DNA, 25 bp, Artificial Sequence
  Corresponding array ID: plastid_2_19
atcagccgcgagctcctctctaggc

SEQ ID NO: 1215 - DNA, 25 bp, Artificial Sequence
  Corresponding array ID: plastid_2_20
ggcgccttcctccaaacggttagaa

SEQ ID NO: 1216 - DNA, 25 bp, Artificial Sequence
  Corresponding array ID: plastid_2_21
ccgcgagctcctctctaggcagaaa

SEQ ID NO: 1217 - DNA, 25 bp, Artificial Sequence
  Corresponding array ID: plastid_2_22
gcatgggtcgatacatgcgacatct

SEQ ID NO: 1218 - DNA, 25 bp, Artificial Sequence
  Corresponding array ID: plastid_2_23
ccgcatgggtcgatacatgcgacat

SEQ ID NO: 1219 - DNA, 25 bp, Artificial Sequence
  Corresponding array ID: plastid_2_24
taccgcatgggtcgatacatgcgac

SEQ ID NO: 1220 - DNA, 25 bp, Artificial Sequence
  Corresponding array ID: plastid_2_25
accgcatgggtcgatacatgcgaca

SEQ ID NO: 1221 - DNA, 25 bp, Artificial Sequence
  Corresponding array ID: plastid_3_1
caccgtcgtatatctgaccgacgat

SEQ ID NO: 1222 - DNA, 25 bp, Artificial Sequence
  Corresponding array ID: plastid_3_2
ttcaccgtcgtatatctgaccgacg

SEQ ID NO: 1223 - DNA, 25 bp, Artificial Sequence
  Corresponding array ID: plastid_3_3
tcaccgtcgtatatctgaccgacga

SEQ ID NO: 1224 - DNA, 25 bp, Artificial Sequence
  Corresponding array ID: plastid_3_4
gtagccgagtttcaggctacaatcc

SEQ ID NO: 1225 - DNA, 25 bp, Artificial Sequence
  Corresponding array ID: plastid_3_5
tagccgagtttcaggctacaatccg

SEQ ID NO: 1226 - DNA, 25 bp, Artificial Sequence
  Corresponding array ID: plastid_3_6
gacctcatcctcaccttcctccaat

SEQ ID NO: 1227 - DNA, 25 bp, Artificial Sequence
  Corresponding array ID: plastid_3_7
agccgagtttcaggctacaatccga

SEQ ID NO: 1228 - DNA, 25 bp, Artificial Sequence
  Corresponding array ID: plastid_3_8
gccgagtttcaggctacaatccgaa

SEQ ID NO: 1229 - DNA, 25 bp, Artificial Sequence
  Corresponding array ID: plastid_3_9
ccgagtttcaggctacaatccgaac

SEQ ID NO: 1230 - DNA, 25 bp, Artificial Sequence
  Corresponding array ID: plastid_3_10
ctcccgtaggagtctgttccgttct

SEQ ID NO: 1231 - DNA, 25 bp, Artificial Sequence
  Corresponding array ID: plastid_3_11
cctcccgtaggagtctgttccgttc

SEQ ID NO: 1232 - DNA, 25 bp, Artificial Sequence
  Corresponding array ID: plastid_3_12
tcccgtaggagtctgttccgttcta

SEQ ID NO: 1233 - DNA, 25 bp, Artificial Sequence
  Corresponding array ID: plastid_3_13
cccgtaggagtctgttccgttctaa

SEQ ID NO: 1234 - DNA, 25 bp, Artificial Sequence
  Corresponding array ID: plastid_3_14
tgacctcatcctcaccttcctccaa

SEQ ID NO: 1235 - DNA, 25 bp, Artificial Sequence
  Corresponding array ID: plastid_3_15
ctaaagcattcatcctccacgcggt

SEQ ID NO: 1236 - DNA, 25 bp, Artificial Sequence
  Corresponding array ID: plastid_3_16
cctaaagcattcatcctccacgcgg

SEQ ID NO: 1237 - DNA, 25 bp, Artificial Sequence
  Corresponding array ID: plastid_3_17
ccctaaagcattcatcctccacgcg

SEQ ID NO: 1238 - DNA, 25 bp, Artificial Sequence
  Corresponding array ID: plastid_3_18
accctaaagcattcatcctccacgc

SEQ ID NO: 1239 - DNA, 25 bp, Artificial Sequence
  Corresponding array ID: plastid_3_19
acataaggggcatgctgacttgacc

SEQ ID NO: 1240 - DNA, 25 bp, Artificial Sequence
  Corresponding array ID: plastid_3_20
gttccgttctaaatcccagtgtggc

SEQ ID NO: 1241 - DNA, 25 bp, Artificial Sequence
  Corresponding array ID: plastid_3_21
cataaggggcatgctgacttgacct

SEQ ID NO: 1242 - DNA, 25 bp, Artificial Sequence
  Corresponding array ID: plastid_3_22
gcggtattgcttggtcaagctttcg

SEQ ID NO: 1243 - DNA, 25 bp, Artificial Sequence
  Corresponding array ID: plastid_3_23
cggtattgcttggtcaagctttcgc

SEQ ID NO: 1244 - DNA, 25 bp, Artificial Sequence
  Corresponding array ID: plastid_3_24
cacgcggtattgcttggtcaagctt

SEQ ID NO: 1245 - DNA, 25 bp, Artificial Sequence
  Corresponding array ID: plastid_3_25
catcctccacgcggtattgcttggt

SEQ ID NO: 1246 - DNA, 25 bp, Artificial Sequence
  Corresponding array ID: plastid_4_1
cttaagcgccgccctccgaatggtt

SEQ ID NO: 1247 - DNA, 25 bp, Artificial Sequence
  Corresponding array ID: plastid_4_2
ccttaagcgccgccctccgaatggt

SEQ ID NO: 1248 - DNA, 25 bp, Artificial Sequence
  Corresponding array ID: plastid_4_3
taccttaagcgccgccctccgaatg

SEQ ID NO: 1249 - DNA, 25 bp, Artificial Sequence
  Corresponding array ID: plastid_4_4
accttaagcgccgccctccgaatgg

SEQ ID NO: 1250 - DNA, 25 bp, Artificial Sequence
  Corresponding array ID: plastid_4_5
agccctaccttaagcgccgccctcc

SEQ ID NO: 1251 - DNA, 25 bp, Artificial Sequence
  Corresponding array ID: plastid_4_6
ttaagcgccgccctccgaatggtta

SEQ ID NO: 1252 - DNA, 25 bp, Artificial Sequence
  Corresponding array ID: plastid_4_7
taagcgccgccctccgaatggttag

SEQ ID NO: 1253 - DNA, 25 bp, Artificial Sequence
  Corresponding array ID: plastid_4_8
tagccctaccttaagcgccgccctc

SEQ ID NO: 1254 - DNA, 25 bp, Artificial Sequence
  Corresponding array ID: plastid_4_9
ctaccttaagcgccgccctccgaat

SEQ ID NO: 1255 - DNA, 25 bp, Artificial Sequence
  Corresponding array ID: plastid_4_10
gccctaccttaagcgccgccctccg

SEQ ID NO: 1256 - DNA, 25 bp, Artificial Sequence
  Corresponding array ID: plastid_4_11
ccctaccttaagcgccgccctccga

SEQ ID NO: 1257 - DNA, 25 bp, Artificial Sequence
  Corresponding array ID: plastid_4_12
cctaccttaagcgccgccctccgaa

SEQ ID NO: 1258 - DNA, 25 bp, Artificial Sequence
  Corresponding array ID: plastid_4_13
ctagccctaccttaagcgccgccct

SEQ ID NO: 1259 - DNA, 25 bp, Artificial Sequence
  Corresponding array ID: plastid_4_14
actagccctaccttaagcgccgccc

SEQ ID NO: 1260 - DNA, 25 bp, Artificial Sequence
  Corresponding array ID: plastid_4_15
aagcgccgccctccgaatggttagg

SEQ ID NO: 1261 - DNA, 25 bp, Artificial Sequence
  Corresponding array ID: plastid_4_16
cactagccctaccttaagcgccgcc

SEQ ID NO: 1262 - DNA, 25 bp, Artificial Sequence
  Corresponding array ID: plastid_4_17
cgccgccctccgaatggttaggcta

SEQ ID NO: 1263 - DNA, 25 bp, Artificial Sequence
  Corresponding array ID: plastid_4_18
gcgccgccctccgaatggttaggct

SEQ ID NO: 1264 - DNA, 25 bp, Artificial Sequence
  Corresponding array ID: plastid_4_19
gccgccctccgaatggttaggctaa

SEQ ID NO: 1265 - DNA, 25 bp, Artificial Sequence
  Corresponding array ID: plastid_4_20
agcgccgccctccgaatggttaggc

SEQ ID NO: 1266 - DNA, 25 bp, Artificial Sequence
  Corresponding array ID: plastid_4_21
acgagattagctagccttcgcaggt

SEQ ID NO: 1267 - DNA, 25 bp, Artificial Sequence
  Corresponding array ID: plastid_4_22
ccgccctccgaatggttaggctaac

SEQ ID NO: 1268 - DNA, 25 bp, Artificial Sequence
  Corresponding array ID: plastid_4_23
cgccctccgaatggttaggctaacg

SEQ ID NO: 1269 - DNA, 25 bp, Artificial Sequence
  Corresponding array ID: plastid_4_24
gccctccgaatggttaggctaacga

SEQ ID NO: 1270 - DNA, 25 bp, Artificial Sequence
  Corresponding array ID: plastid_4_25
tcactagccctaccttaagcgccgc

SEQ ID NO: 1271 - DNA, 25 bp, Artificial Sequence
  Corresponding array ID: plastid_5_1
ctctacccctaccatactcaagcct

SEQ ID NO: 1272 - DNA, 25 bp, Artificial Sequence
  Corresponding array ID: plastid_5_2
gacgtcgtcctccaaatggttagac

SEQ ID NO: 1273 - DNA, 25 bp, Artificial Sequence
  Corresponding array ID: plastid_5_3
ccttagacgtcgtcctccaaatggt

SEQ ID NO: 1274 - DNA, 25 bp, Artificial Sequence
  Corresponding array ID: plastid_5_4
accttagacgtcgtcctccaaatgg

SEQ ID NO: 1275 - DNA, 25 bp, Artificial Sequence
  Corresponding array ID: plastid_5_5
cctctacccctaccatactcaagcc

SEQ ID NO: 1276 - DNA, 25 bp, Artificial Sequence
  Corresponding array ID: plastid_5_6
gctagttctcgcgaatttgcgactc

SEQ ID NO: 1277 - DNA, 25 bp, Artificial Sequence
  Corresponding array ID: plastid_5_7
cctctcggcatatggggatttagct

SEQ ID NO: 1278 - DNA, 25 bp, Artificial Sequence
  Corresponding array ID: plastid_5_8
gactaacggtgttgggtatgaccag

SEQ ID NO: 1279 - DNA, 25 bp, Artificial Sequence
  Corresponding array ID: plastid_5_9
actaacggtgttgggtatgaccagc

SEQ ID NO: 1280 - DNA, 25 bp, Artificial Sequence
  Corresponding array ID: plastid_5_10
ccaacagttattcccctcctaaggg

SEQ ID NO: 1281 - DNA, 25 bp, Artificial Sequence
  Corresponding array ID: plastid_5_11
ctctcggcatatggggatttagctg

SEQ ID NO: 1282 - DNA, 25 bp, Artificial Sequence
  Corresponding array ID: plastid_5_12
gcgcgagctcatccttaggcagtgt

SEQ ID NO: 1283 - DNA, 25 bp, Artificial Sequence
  Corresponding array ID: plastid_5_13
cgcgagctcatccttaggcagtgta

SEQ ID NO: 1284 - DNA, 25 bp, Artificial Sequence
  Corresponding array ID: plastid_5_14
gcgagctcatccttaggcagtgtaa

SEQ ID NO: 1285 - DNA, 25 bp, Artificial Sequence
  Corresponding array ID: plastid_5_15
cacctctcggcatatggggatttag

SEQ ID NO: 1286 - DNA, 25 bp, Artificial Sequence
  Corresponding array ID: plastid_5_16
acctctcggcatatggggatttagc

SEQ ID NO: 1287 - DNA, 25 bp, Artificial Sequence
  Corresponding array ID: plastid_5_17
gcagcctacaatccgaacttggaca

SEQ ID NO: 1288 - DNA, 25 bp, Artificial Sequence
  Corresponding array ID: plastid_5_18
ggcgcgagctcatccttaggcagtg

SEQ ID NO: 1289 - DNA, 25 bp, Artificial Sequence
  Corresponding array ID: plastid_5_19
cggcagtctctctagagatcccaat

SEQ ID NO: 1290 - DNA, 25 bp, Artificial Sequence
  Corresponding array ID: plastid_5_20
atcaccggcagtctctctagagatc

SEQ ID NO: 1291 - DNA, 25 bp, Artificial Sequence
  Corresponding array ID: plastid_5_21
caccggcagtctctctagagatccc

SEQ ID NO: 1292 - DNA, 25 bp, Artificial Sequence
  Corresponding array ID: plastid_5_22
accggcagtctctctagagatccca

SEQ ID NO: 1293 - DNA, 25 bp, Artificial Sequence
  Corresponding array ID: plastid_5_23
ccggcagtctctctagagatcccaa

SEQ ID NO: 1294 - DNA, 25 bp, Artificial Sequence
  Corresponding array ID: plastid_5_24
ttcgcctctcagtgtcagtaatggc

SEQ ID NO: 1295 - DNA, 25 bp, Artificial Sequence
  Corresponding array ID: plastid_5_25
tcgcctctcagtgtcagtaatggcc

SEQ ID NO: 1296 - DNA, 25 bp, Artificial Sequence
  Corresponding array ID: margrpA_1_1
gctccggtaccgaaggggtcgaatc

SEQ ID NO: 1297 - DNA, 25 bp, Artificial Sequence
  Corresponding array ID: margrpA_1_2
agctccggtaccgaaggggtcgaat

SEQ ID NO: 1298 - DNA, 25 bp, Artificial Sequence
  Corresponding array ID: margrpA_1_3
cacccgattcgggtactactgactt

SEQ ID NO: 1299 - DNA, 25 bp, Artificial Sequence
  Corresponding array ID: margrpA_1_4
acccgattcgggtactactgacttc

SEQ ID NO: 1300 - DNA, 25 bp, Artificial Sequence
  Corresponding array ID: margrpA_1_5
ctccggtaccgaaggggtcgaatcc

SEQ ID NO: 1301 - DNA, 25 bp, Artificial Sequence
  Corresponding array ID: margrpA_1_6
ccacccgattcgggtactactgact

SEQ ID NO: 1302 - DNA, 25 bp, Artificial Sequence
  Corresponding array ID: margrpA_1_7
gccacccgattcgggtactactgac

SEQ ID NO: 1303 - DNA, 25 bp, Artificial Sequence
  Corresponding array ID: margrpA_1_8
ggccacccgattcgggtactactga

SEQ ID NO: 1304 - DNA, 25 bp, Artificial Sequence
  Corresponding array ID: margrpA_1_9
tagctccggtaccgaaggggtcgaa

SEQ ID NO: 1305 - DNA, 25 bp, Artificial Sequence
  Corresponding array ID: margrpA_1_10
tccggtaccgaaggggtcgaatccc

SEQ ID NO: 1306 - DNA, 25 bp, Artificial Sequence
  Corresponding array ID: margrpA_1_11
gaaggggtcgaatcccccgacacca

SEQ ID NO: 1307 - DNA, 25 bp, Artificial Sequence
  Corresponding array ID: margrpA_1_12
aaggggtcgaatcccccgacaccaa

SEQ ID NO: 1308 - DNA, 25 bp, Artificial Sequence
  Corresponding array ID: margrpA_1_13
cttcccttacgacagacctttacgc

SEQ ID NO: 1309 - DNA, 25 bp, Artificial Sequence
  Corresponding array ID: margrpA_1_14
cccgattcgggtactactgacttcc

SEQ ID NO: 1310 - DNA, 25 bp, Artificial Sequence
  Corresponding array ID: margrpA_1_15
acaactgtatcccgaaggatccgct

SEQ ID NO: 1311 - DNA, 25 bp, Artificial Sequence
  Corresponding array ID: margrpA_1_16
caactgtatcccgaaggatccgctg

SEQ ID NO: 1312 - DNA, 25 bp, Artificial Sequence
  Corresponding array ID: margrpA_1_17
aactgtatcccgaaggatccgctgc

SEQ ID NO: 1313 - DNA, 25 bp, Artificial Sequence
  Corresponding array ID: margrpA_1_18
aacaactgtatcccgaaggatccgc

SEQ ID NO: 1314 - DNA, 25 bp, Artificial Sequence
  Corresponding array ID: margrpA_1_19
gttagctccggtaccgaaggggtcg

SEQ ID NO: 1315 - DNA, 25 bp, Artificial Sequence
  Corresponding array ID: margrpA_1_20
ttagctccggtaccgaaggggtcga

SEQ ID NO: 1316 - DNA, 25 bp, Artificial Sequence
  Corresponding array ID: margrpA_1_21
gcgttagctccggtaccgaaggggt

SEQ ID NO: 1317 - DNA, 25 bp, Artificial Sequence
  Corresponding array ID: margrpA_1_22
cgttagctccggtaccgaaggggtc

SEQ ID NO: 1318 - DNA, 25 bp, Artificial Sequence
  Corresponding array ID: margrpA_1_23
tgcgttagctccggtaccgaagggg

SEQ ID NO: 1319 - DNA, 25 bp, Artificial Sequence
  Corresponding array ID: margrpA_1_24
tcccttacgacagacctttacgctc

SEQ ID NO: 1320 - DNA, 25 bp, Artificial Sequence
  Corresponding array ID: margrpA_1_25
actgtatcccgaaggatccgctgca

SEQ ID NO: 1321 - DNA, 25 bp, Artificial Sequence
  Corresponding array ID: margrpA_2_1
gctgccttcgcatttgactttcctc

SEQ ID NO: 1322 - DNA, 25 bp, Artificial Sequence
  Corresponding array ID: margrpA_2_2
ggctgccttcgcatttgactttcct

SEQ ID NO: 1323 - DNA, 25 bp, Artificial Sequence
  Corresponding array ID: margrpA_2_3
aggctgccttcgcatttgactttcc

SEQ ID NO: 1324 - DNA, 25 bp, Artificial Sequence
  Corresponding array ID: margrpA_2_4
acaactgtgctccgaagagcccgct

SEQ ID NO: 1325 - DNA, 25 bp, Artificial Sequence
  Corresponding array ID: margrpA_2_5
taacaactgtgctccgaagagcccg

SEQ ID NO: 1326 - DNA, 25 bp, Artificial Sequence
  Corresponding array ID: margrpA_2_6
aacaactgtgctccgaagagcccgc

SEQ ID NO: 1327 - DNA, 25 bp, Artificial Sequence
  Corresponding array ID: margrpA_2_7
gataccatcttcgggtactgcagac

SEQ ID NO: 1328 - DNA, 25 bp, Artificial Sequence
  Corresponding array ID: margrpA_2_8
ttaacaactgtgctccgaagagccc

SEQ ID NO: 1329 - DNA, 25 bp, Artificial Sequence
  Corresponding array ID: margrpA_2_9
caactgtgctccgaagagcccgctg

SEQ ID NO: 1330 - DNA, 25 bp, Artificial Sequence
  Corresponding array ID: margrpA_2_10
cagaaggctgccttcgcatttgact

SEQ ID NO: 1331 - DNA, 25 bp, Artificial Sequence
  Corresponding array ID: margrpA_2_11
accatcttcgggtactgcagacttc

SEQ ID NO: 1332 - DNA, 25 bp, Artificial Sequence
  Corresponding array ID: margrpA_2_12
ttgcggttaggataccatcttcggg

SEQ ID NO: 1333 - DNA, 25 bp, Artificial Sequence
  Corresponding array ID: margrpA_2_13
cttgcggttaggataccatcttcgg

SEQ ID NO: 1334 - DNA, 25 bp, Artificial Sequence
  Corresponding array ID: margrpA_2_14
ccttgcggttaggataccatcttcg

SEQ ID NO: 1335 - DNA, 25 bp, Artificial Sequence
  Corresponding array ID: margrpA_2_15
ccatcttcgggtactgcagacttcc

SEQ ID NO: 1336 - DNA, 25 bp, Artificial Sequence
  Corresponding array ID: margrpA_2_16
ggataccatcttcgggtactgcaga

SEQ ID NO: 1337 - DNA, 25 bp, Artificial Sequence
  Corresponding array ID: margrpA_2_17
acctgccttaccttaaacagctccc

SEQ ID NO: 1338 - DNA, 25 bp, Artificial Sequence
  Corresponding array ID: margrpA_2_18
cctgccttaccttaaacagctccct

SEQ ID NO: 1339 - DNA, 25 bp, Artificial Sequence
  Corresponding array ID: margrpA_2_19
ccagaaggctgccttcgcatttgac

SEQ ID NO: 1340 - DNA, 25 bp, Artificial Sequence
  Corresponding array ID: margrpA_2_20
tgcggttaggataccatcttcgggt

SEQ ID NO: 1341 - DNA, 25 bp, Artificial Sequence
  Corresponding array ID: margrpA_2_21
cgaagagcccgctgcattatttggt

SEQ ID NO: 1342 - DNA, 25 bp, Artificial Sequence
  Corresponding array ID: margrpA_2_22
ccaccatgaattctgcgttcctctc

SEQ ID NO: 1343 - DNA, 25 bp, Artificial Sequence
  Corresponding array ID: margrpA_2_23
cctccttgcggttaggataccatct

SEQ ID NO: 1344 - DNA, 25 bp, Artificial Sequence
  Corresponding array ID: margrpA_2_24
catcttcgggtactgcagacttcca

SEQ ID NO: 1345 - DNA, 25 bp, Artificial Sequence
  Corresponding array ID: margrpA_2_25
cggttaggataccatcttcgggtac

SEQ ID NO: 1346 - DNA, 25 bp, Artificial Sequence
  Corresponding array ID: OP10_1_1
ccgcttgcacgggcagttccgtaag

SEQ ID NO: 1347 - DNA, 25 bp, Artificial Sequence
  Corresponding array ID: OP10_1_2
cccgcttgcacgggcagttccgtaa

SEQ ID NO: 1348 - DNA, 25 bp, Artificial Sequence
  Corresponding array ID: OP10_1_3
cgcttgcacgggcagttccgtaaga

SEQ ID NO: 1349 - DNA, 25 bp, Artificial Sequence
  Corresponding array ID: OP10_1_4
tcccgcttgcacgggcagttccgta

SEQ ID NO: 1350 - DNA, 25 bp, Artificial Sequence
  Corresponding array ID: OP10_1_5
gggtgcagacaattcaggtgacttg

SEQ ID NO: 1351 - DNA, 25 bp, Artificial Sequence
  Corresponding array ID: OP10_1_6
ctcccgcttgcacgggcagttccgt

SEQ ID NO: 1352 - DNA, 25 bp, Artificial Sequence
  Corresponding array ID: OP10_1_7
cctcccgcttgcacgggcagttccg

SEQ ID NO: 1353 - DNA, 25 bp, Artificial Sequence
  Corresponding array ID: OP10_1_8
gcttgcacgggcagttccgtaagag

SEQ ID NO: 1354 - DNA, 25 bp, Artificial Sequence
  Corresponding array ID: OP10_1_9
cgggtgcagacaattcaggtgactt

SEQ ID NO: 1355 - DNA, 25 bp, Artificial Sequence
  Corresponding array ID: OP10_1_10
ccgtaagagttcccgactttacgct

SEQ ID NO: 1356 - DNA, 25 bp, Artificial Sequence
  Corresponding array ID: OP10_1_11
gcagacaattcaggtgacttgacgg

SEQ ID NO: 1357 - DNA, 25 bp, Artificial Sequence
  Corresponding array ID: OP10_1_12
tcgggtgcagacaattcaggtgact

SEQ ID NO: 1358 - DNA, 25 bp, Artificial Sequence
  Corresponding array ID: OP10_1_13
cgtaagagttcccgactttacgctg

SEQ ID NO: 1359 - DNA, 25 bp, Artificial Sequence
  Corresponding array ID: OP10_1_14
ttgcacgggcagttccgtaagagtt

SEQ ID NO: 1360 - DNA, 25 bp, Artificial Sequence
  Corresponding array ID: OP10_1_15
tccgtaagagttcccgactttacgc

SEQ ID NO: 1361 - DNA, 25 bp, Artificial Sequence
  Corresponding array ID: OP10_1_16
ggcagttccgtaagagttcccgact

SEQ ID NO: 1362 - DNA, 25 bp, Artificial Sequence
  Corresponding array ID: OP10_1_17
cttgcacgggcagttccgtaagagt

SEQ ID NO: 1363 - DNA, 25 bp, Artificial Sequence
  Corresponding array ID: OP10_1_18
cgggcagttccgtaagagttcccga

SEQ ID NO: 1364 - DNA, 25 bp, Artificial Sequence
  Corresponding array ID: OP10_1_19
tgcacgggcagttccgtaagagttc

SEQ ID NO: 1365 - DNA, 25 bp, Artificial Sequence
  Corresponding array ID: OP10_1_20
acgggcagttccgtaagagttcccg

SEQ ID NO: 1366 - DNA, 25 bp, Artificial Sequence
  Corresponding array ID: OP10_1_21
gcacgggcagttccgtaagagttcc

SEQ ID NO: 1367 - DNA, 25 bp, Artificial Sequence
  Corresponding array ID: OP10_1_22
cacgggcagttccgtaagagttccc

SEQ ID NO: 1368 - DNA, 25 bp, Artificial Sequence
  Corresponding array ID: OP10_1_23
gcagttccgtaagagttcccgactt

SEQ ID NO: 1369 - DNA, 25 bp, Artificial Sequence
  Corresponding array ID: OP10_1_24
gggcagttccgtaagagttcccgac

SEQ ID NO: 1370 - DNA, 25 bp, Artificial Sequence
  Corresponding array ID: OP10_1_25
cccccttactccccacaccttagac

SEQ ID NO: 1371 - DNA, 25 bp, Artificial Sequence
  Corresponding array ID: OP3_1_1
atccaagggtgataggtccttacgg

SEQ ID NO: 1372 - DNA, 25 bp, Artificial Sequence
  Corresponding array ID: OP3_1_2
tccaagggtgataggtccttacgga

SEQ ID NO: 1373 - DNA, 25 bp, Artificial Sequence
  Corresponding array ID: OP3_1_3
ccaagggtgataggtccttacggat

SEQ ID NO: 1374 - DNA, 25 bp, Artificial Sequence
  Corresponding array ID: OP3_1_4
tgttctcccctgctgacaggagttt

SEQ ID NO: 1375 - DNA, 25 bp, Artificial Sequence
  Corresponding array ID: OP3_1_5
ttgttctcccctgctgacaggagtt

SEQ ID NO: 1376 - DNA, 25 bp, Artificial Sequence
  Corresponding array ID: OP3_1_6
cttgttctcccctgctgacaggagt

SEQ ID NO: 1377 - DNA, 25 bp, Artificial Sequence
  Corresponding array ID: OP3_1_7
gttctcccctgctgacaggagttta

SEQ ID NO: 1378 - DNA, 25 bp, Artificial Sequence
  Corresponding array ID: OP3_1_8
catccaagggtgataggtccttacg

SEQ ID NO: 1379 - DNA, 25 bp, Artificial Sequence
  Corresponding array ID: OP3_1_9
tcgacaggttatcccgaaccctagg

SEQ ID NO: 1380 - DNA, 25 bp, Artificial Sequence
  Corresponding array ID: OP3_1_10
ttcgacaggttatcccgaaccctag

SEQ ID NO: 1381 - DNA, 25 bp, Artificial Sequence
  Corresponding array ID: OP3_1_11
ttctcccctgctgacaggagtttac

SEQ ID NO: 1382 - DNA, 25 bp, Artificial Sequence
  Corresponding array ID: OP3_1_12
ccatccaagggtgataggtccttac

SEQ ID NO: 1383 - DNA, 25 bp, Artificial Sequence
  Corresponding array ID: OP3_1_13
tgataggtccttacggatccccatc

SEQ ID NO: 1384 - DNA, 25 bp, Artificial Sequence
  Corresponding array ID: OP3_1_14
tctcccctgctgacaggagtttaca

SEQ ID NO: 1385 - DNA, 25 bp, Artificial Sequence
  Corresponding array ID: OP3_1_15
cggatccccatctttccctcatgtt

SEQ ID NO: 1386 - DNA, 25 bp, Artificial Sequence
  Corresponding array ID: OP3_1_16
tccttgccggttaggcaacctactt

SEQ ID NO: 1387 - DNA, 25 bp, Artificial Sequence
  Corresponding array ID: OP3_1_17
agtgcgcaccgaccgaagtcggtgt

SEQ ID NO: 1388 - DNA, 25 bp, Artificial Sequence
  Corresponding array ID: OP3_1_18
ccagtaatgcgccttcgcgactggt

SEQ ID NO: 1389 - DNA, 25 bp, Artificial Sequence
  Corresponding array ID: OP3_1_19
agagtgcgcaccgaccgaagtcggt

SEQ ID NO: 1390 - DNA, 25 bp, Artificial Sequence
  Corresponding array ID: OP3_1_20
tcgaaaagcacaggacgtatccggt

SEQ ID NO: 1391 - DNA, 25 bp, Artificial Sequence
  Corresponding array ID: OP3_1_21
ctgtgcttcgaaaagcacaggacgt

SEQ ID NO: 1392 - DNA, 25 bp, Artificial Sequence
  Corresponding array ID: OP3_1_22
ccttagagtgcgcaccgaccgaagt

SEQ ID NO: 1393 - DNA, 25 bp, Artificial Sequence
  Corresponding array ID: OP3_1_23
gccctccttgccggttaggcaacct

SEQ ID NO: 1394 - DNA, 25 bp, Artificial Sequence
  Corresponding array ID: OP3_1_24
ctccttgccggttaggcaacctact

SEQ ID NO: 1395 - DNA, 25 bp, Artificial Sequence
  Corresponding array ID: OP3_1_25
cagtaatgcgccttcgcgactggtg

SEQ ID NO: 1396 - DNA, 25 bp, Artificial Sequence
  Corresponding array ID: OP9_1_1
gggcaagataatgtcaagtcccggt

SEQ ID NO: 1397 - DNA, 25 bp, Artificial Sequence
  Corresponding array ID: OP9_1_2
gctggcacataattagccggagctt

SEQ ID NO: 1398 - DNA, 25 bp, Artificial Sequence
  Corresponding array ID: OP9_1_3
tgctggcacataattagccggagct

SEQ ID NO: 1399 - DNA, 25 bp, Artificial Sequence
  Corresponding array ID: OP9_1_4
cccacttacagggtagattacccac

SEQ ID NO: 1400 - DNA, 25 bp, Artificial Sequence
  Corresponding array ID: OP9_1_5
ccccacttacagggtagattaccca

SEQ ID NO: 1401 - DNA, 25 bp, Artificial Sequence
  Corresponding array ID: OP9_1_6
cccccacttacagggtagattaccc

SEQ ID NO: 1402 - DNA, 25 bp, Artificial Sequence
  Corresponding array ID: OP9_1_7
ctgctaacctcatcatcccgaagga

SEQ ID NO: 1403 - DNA, 25 bp, Artificial Sequence
  Corresponding array ID: OP9_1_8
tctgctaacctcatcatcccgaagg

SEQ ID NO: 1404 - DNA, 25 bp, Artificial Sequence
  Corresponding array ID: OP9_1_9
ctgctggcacataattagccggagc

SEQ ID NO: 1405 - DNA, 25 bp, Artificial Sequence
  Corresponding array ID: OP9_1_10
ccacttacagggtagattacccacg

SEQ ID NO: 1406 - DNA, 25 bp, Artificial Sequence
  Corresponding array ID: OP9_1_11
gacgggcaagataatgtcaagtccc

SEQ ID NO: 1407 - DNA, 25 bp, Artificial Sequence
  Corresponding array ID: OP9_1_12
tcccccacttacagggtagattacc

SEQ ID NO: 1408 - DNA, 25 bp, Artificial Sequence
  Corresponding array ID: OP9_1_13
gcagtctgcctagagtgcacttgta

SEQ ID NO: 1409 - DNA, 25 bp, Artificial Sequence
  Corresponding array ID: OP9_1_14
gctgctggcacataattagccggag

SEQ ID NO: 1410 - DNA, 25 bp, Artificial Sequence
  Corresponding array ID: OP9_1_15
gggtaccgtcaggcttaagggttta

SEQ ID NO: 1411 - DNA, 25 bp, Artificial Sequence
  Corresponding array ID: OP9_1_16
cacttacagggtagattacccacgc

SEQ ID NO: 1412 - DNA, 25 bp, Artificial Sequence
  Corresponding array ID: OP9_1_17
ggcagtctgcctagagtgcacttgt

SEQ ID NO: 1413 - DNA, 25 bp, Artificial Sequence
  Corresponding array ID: OP9_1_18
ggttatcccccacttacagggtaga

SEQ ID NO: 1414 - DNA, 25 bp, Artificial Sequence
  Corresponding array ID: OP9_1_19
gagggttatcccccacttacagggt

SEQ ID NO: 1415 - DNA, 25 bp, Artificial Sequence
  Corresponding array ID: OP9_1_20
gggttatcccccacttacagggtag

SEQ ID NO: 1416 - DNA, 25 bp, Artificial Sequence
  Corresponding array ID: OP9_1_21
gtcagagatagaccagaaagccgcc

SEQ ID NO: 1417 - DNA, 25 bp, Artificial Sequence
  Corresponding array ID: OP9_1_22
ggggtaccgtcaggcttaagggttt

SEQ ID NO: 1418 - DNA, 25 bp, Artificial Sequence
  Corresponding array ID: OP9_1_23
agggttatcccccacttacagggta

SEQ ID NO: 1419 - DNA, 25 bp, Artificial Sequence
  Corresponding array ID: OP9_1_24
cggcagtctgcctagagtgcacttg

SEQ ID NO: 1420 - DNA, 25 bp, Artificial Sequence
  Corresponding array ID: OP9_1_25
ctccgcattatctgcggcagtctgc

SEQ ID NO: 1421 - DNA, 25 bp, Artificial Sequence
  Corresponding array ID: plancto_1_1
tgcaacacctgtgcaggtcacaccc

SEQ ID NO: 1422 - DNA, 25 bp, Artificial Sequence
  Corresponding array ID: plancto_1_2
gcaacacctgtgcaggtcacacccg

SEQ ID NO: 1423 - DNA, 25 bp, Artificial Sequence
  Corresponding array ID: plancto_1_3
atgcaacacctgtgcaggtcacacc

SEQ ID NO: 1424 - DNA, 25 bp, Artificial Sequence
  Corresponding array ID: plancto_1_4
aacacctgtgcaggtcacacccgaa

SEQ ID NO: 1425 - DNA, 25 bp, Artificial Sequence
  Corresponding array ID: plancto_1_5
caacacctgtgcaggtcacacccga

SEQ ID NO: 1426 - DNA, 25 bp, Artificial Sequence
  Corresponding array ID: plancto_1_6
tgtgcaggtcacacccgaaggtaat

SEQ ID NO: 1427 - DNA, 25 bp, Artificial Sequence
  Corresponding array ID: plancto_1_7
gtgcaggtcacacccgaaggtaatc

SEQ ID NO: 1428 - DNA, 25 bp, Artificial Sequence
  Corresponding array ID: plancto_1_8
tgcaggtcacacccgaaggtaatca

SEQ ID NO: 1429 - DNA, 25 bp, Artificial Sequence
  Corresponding array ID: plancto_1_9
ctgtgcaggtcacacccgaaggtaa

SEQ ID NO: 1430 - DNA, 25 bp, Artificial Sequence
  Corresponding array ID: plancto_1_10
cctgtgcaggtcacacccgaaggta

SEQ ID NO: 1431 - DNA, 25 bp, Artificial Sequence
  Corresponding array ID: plancto_1_11
acacctgtgcaggtcacacccgaag

SEQ ID NO: 1432 - DNA, 25 bp, Artificial Sequence
  Corresponding array ID: plancto_1_12
acagagttagccagtgcttcctctc

SEQ ID NO: 1433 - DNA, 25 bp, Artificial Sequence
  Corresponding array ID: plancto_1_13
acctgtgcaggtcacacccgaaggt

SEQ ID NO: 1434 - DNA, 25 bp, Artificial Sequence
  Corresponding array ID: plancto_1_14
catgcaacacctgtgcaggtcacac

SEQ ID NO: 1435 - DNA, 25 bp, Artificial Sequence
  Corresponding array ID: plancto_1_15
cacctgtgcaggtcacacccgaagg

SEQ ID NO: 1436 - DNA, 25 bp, Artificial Sequence
  Corresponding array ID: plancto_1_16
cacagagttagccagtgcttcctct

SEQ ID NO: 1437 - DNA, 25 bp, Artificial Sequence
  Corresponding array ID: plancto_1_17
cagagttagccagtgcttcctctcg

SEQ ID NO: 1438 - DNA, 25 bp, Artificial Sequence
  Corresponding array ID: plancto_1_18
agccagtgcttcctctcgagcttac

SEQ ID NO: 1439 - DNA, 25 bp, Artificial Sequence
  Corresponding array ID: plancto_1_19
gcacagagttagccagtgcttcctc

SEQ ID NO: 1440 - DNA, 25 bp, Artificial Sequence
  Corresponding array ID: plancto_1_20
ggcctagcccctgcatgtcaagcct

SEQ ID NO: 1441 - DNA, 25 bp, Artificial Sequence
  Corresponding array ID: plancto_1_21
gcaggtcacacccgaaggtaatcag

SEQ ID NO: 1442 - DNA, 25 bp, Artificial Sequence
  Corresponding array ID: plancto_1_22
accggcctagcccctgcatgtcaag

SEQ ID NO: 1443 - DNA, 25 bp, Artificial Sequence
  Corresponding array ID: plancto_1_23
caggtcacacccgaaggtaatcagc

SEQ ID NO: 1444 - DNA, 25 bp, Artificial Sequence
  Corresponding array ID: plancto_1_24
ccggcctagcccctgcatgtcaagc

SEQ ID NO: 1445 - DNA, 25 bp, Artificial Sequence
  Corresponding array ID: plancto_1_25
cggcctagcccctgcatgtcaagcc

SEQ ID NO: 1446 - DNA, 25 bp, Artificial Sequence
  Corresponding array ID: plancto_2_1
tctccgaagagcactctcccctttc

SEQ ID NO: 1447 - DNA, 25 bp, Artificial Sequence
  Corresponding array ID: plancto_2_2
tacgaccgagaaactgtgggaggtc

SEQ ID NO: 1448 - DNA, 25 bp, Artificial Sequence
  Corresponding array ID: plancto_2_3
accgagaaactgtgggaggtccctc

SEQ ID NO: 1449 - DNA, 25 bp, Artificial Sequence
  Corresponding array ID: plancto_2_4
cgaccgagaaactgtgggaggtccc

SEQ ID NO: 1450 - DNA, 25 bp, Artificial Sequence
  Corresponding array ID: plancto_2_5
ctccgaagagcactctcccctttca

SEQ ID NO: 1451 - DNA, 25 bp, Artificial Sequence
  Corresponding array ID: plancto_2_6
gcccgaccttcctctgaggtttggt

SEQ ID NO: 1452 - DNA, 25 bp, Artificial Sequence
  Corresponding array ID: plancto_2_7
aaactgtgggaggtccctcgatcca

SEQ ID NO: 1453 - DNA, 25 bp, Artificial Sequence
  Corresponding array ID: plancto_2_8
tccgaagagcactctcccctttcag

SEQ ID NO: 1454 - DNA, 25 bp, Artificial Sequence
  Corresponding array ID: plancto_2_9
gaccgagaaactgtgggaggtccct

SEQ ID NO: 1455 - DNA, 25 bp, Artificial Sequence
  Corresponding array ID: plancto_2_10
acgaccgagaaactgtgggaggtcc

SEQ ID NO: 1456 - DNA, 25 bp, Artificial Sequence
  Corresponding array ID: plancto_2_11
gaaactgtgggaggtccctcgatcc

SEQ ID NO: 1457 - DNA, 25 bp, Artificial Sequence
  Corresponding array ID: plancto_2_12
ctctccgaagagcactctccccttt

SEQ ID NO: 1458 - DNA, 25 bp, Artificial Sequence
  Corresponding array ID: plancto_2_13
gcctggaggtaggtatctacctgtt

SEQ ID NO: 1459 - DNA, 25 bp, Artificial Sequence
  Corresponding array ID: plancto_2_14
tcccgacgctattcccagcctggag

SEQ ID NO: 1460 - DNA, 25 bp, Artificial Sequence
  Corresponding array ID: plancto_2_15
ttgggcattaccgccagtttcccga

SEQ ID NO: 1461 - DNA, 25 bp, Artificial Sequence
  Corresponding array ID: plancto_2_16
ccgagaaactgtgggaggtccctcg

SEQ ID NO: 1462 - DNA, 25 bp, Artificial Sequence
  Corresponding array ID: plancto_2_17
tgagcagacccatctccaggcgccg

SEQ ID NO: 1463 - DNA, 25 bp, Artificial Sequence
  Corresponding array ID: plancto_2_18
aactgtgggaggtccctcgatccag

SEQ ID NO: 1464 - DNA, 25 bp, Artificial Sequence
  Corresponding array ID: plancto_2_19
cccgaccttcctctgaggtttggtc

SEQ ID NO: 1465 - DNA, 25 bp, Artificial Sequence
  Corresponding array ID: plancto_2_20
tgggcattaccgccagtttcccgac

SEQ ID NO: 1466 - DNA, 25 bp, Artificial Sequence
  Corresponding array ID: plancto_2_21
cgagaaactgtgggaggtccctcga

SEQ ID NO: 1467 - DNA, 25 bp, Artificial Sequence
  Corresponding array ID: plancto_2_22
gagaaactgtgggaggtccctcgat

SEQ ID NO: 1468 - DNA, 25 bp, Artificial Sequence
  Corresponding array ID: plancto_2_23
cagcctggaggtaggtatctacctg

SEQ ID NO: 1469 - DNA, 25 bp, Artificial Sequence
  Corresponding array ID: plancto_2_24
agcccgaccttcctctgaggtttgg

SEQ ID NO: 1470 - DNA, 25 bp, Artificial Sequence
  Corresponding array ID: plancto_2_25
aatagtgagcagacccatctccagg

SEQ ID NO: 1471 - DNA, 25 bp, Artificial Sequence
  Corresponding array ID: plancto_3_1
cgcagtgcctcagttaagctcaggc

SEQ ID NO: 1472 - DNA, 25 bp, Artificial Sequence
  Corresponding array ID: plancto_3_2
gcagtgcctcagttaagctcaggca

SEQ ID NO: 1473 - DNA, 25 bp, Artificial Sequence
  Corresponding array ID: plancto_3_3
caactctgagggagtaccctcagag

SEQ ID NO: 1474 - DNA, 25 bp, Artificial Sequence
  Corresponding array ID: plancto_3_4
gtcaactctgagggagtaccctcag

SEQ ID NO: 1475 - DNA, 25 bp, Artificial Sequence
  Corresponding array ID: plancto_3_5
tatgttttcctacgccgttcgccgc

SEQ ID NO: 1476 - DNA, 25 bp, Artificial Sequence
  Corresponding array ID: plancto_3_6
gcagaaagaggaaacctcctcccgc

SEQ ID NO: 1477 - DNA, 25 bp, Artificial Sequence
  Corresponding array ID: plancto_3_7
aactctgagggagtaccctcagaga

SEQ ID NO: 1478 - DNA, 25 bp, Artificial Sequence
  Corresponding array ID: plancto_3_8
tcaactctgagggagtaccctcaga

SEQ ID NO: 1479 - DNA, 25 bp, Artificial Sequence
  Corresponding array ID: plancto_3_9
ctatgttttcctacgccgttcgccg

SEQ ID NO: 1480 - DNA, 25 bp, Artificial Sequence
  Corresponding array ID: plancto_3_10
tcctatgttttcctacgccgttcgc

SEQ ID NO: 1481 - DNA, 25 bp, Artificial Sequence
  Corresponding array ID: plancto_3_11
cctatgttttcctacgccgttcgcc

SEQ ID NO: 1482 - DNA, 25 bp, Artificial Sequence
  Corresponding array ID: plancto_3_12
actctgagggagtaccctcagagat

SEQ ID NO: 1483 - DNA, 25 bp, Artificial Sequence
  Corresponding array ID: plancto_3_13
acgcagtgcctcagttaagctcagg

SEQ ID NO: 1484 - DNA, 25 bp, Artificial Sequence
  Corresponding array ID: plancto_3_14
tgtcaactctgagggagtaccctca

SEQ ID NO: 1485 - DNA, 25 bp, Artificial Sequence
  Corresponding array ID: plancto_3_15
atgttttcctacgccgttcgccgct

SEQ ID NO: 1486 - DNA, 25 bp, Artificial Sequence
  Corresponding array ID: plancto_3_16
aacgcagtgcctcagttaagctcag

SEQ ID NO: 1487 - DNA, 25 bp, Artificial Sequence
  Corresponding array ID: plancto_3_17
cagtgcctcagttaagctcaggcat

SEQ ID NO: 1488 - DNA, 25 bp, Artificial Sequence
  Corresponding array ID: plancto_3_18
ctgtcaactctgagggagtaccctc

SEQ ID NO: 1489 - DNA, 25 bp, Artificial Sequence
  Corresponding array ID: plancto_3_19
ctctgagggagtaccctcagagatt

SEQ ID NO: 1490 - DNA, 25 bp, Artificial Sequence
  Corresponding array ID: plancto_3_20
tctgtcaactctgagggagtaccct

SEQ ID NO: 1491 - DNA, 25 bp, Artificial Sequence
  Corresponding array ID: plancto_3_21
ggagtaccctcagagatttcatccc

SEQ ID NO: 1492 - DNA, 25 bp, Artificial Sequence
  Corresponding array ID: plancto_3_22
caaacgcagtgcctcagttaagctc

SEQ ID NO: 1493 - DNA, 25 bp, Artificial Sequence
  Corresponding array ID: plancto_3_23
ctctgtcaactctgagggagtaccc

SEQ ID NO: 1494 - DNA, 25 bp, Artificial Sequence
  Corresponding array ID: plancto_3_24
acagcagaaagaggaaacctcctcc

SEQ ID NO: 1495 - DNA, 25 bp, Artificial Sequence
  Corresponding array ID: plancto_3_25
ctgagggagtaccctcagagatttc

SEQ ID NO: 1496 - DNA, 25 bp, Artificial Sequence
  Corresponding array ID: plancto_4_1
actacctaatatcgcatcggccgct

SEQ ID NO: 1497 - DNA, 25 bp, Artificial Sequence
  Corresponding array ID: plancto_4_2
caactacctaatatcgcatcggccg

SEQ ID NO: 1498 - DNA, 25 bp, Artificial Sequence
  Corresponding array ID: plancto_4_3
aactacctaatatcgcatcggccgc

SEQ ID NO: 1499 - DNA, 25 bp, Artificial Sequence
  Corresponding array ID: plancto_4_4
ccaactacctaatatcgcatcggcc

SEQ ID NO: 1500 - DNA, 25 bp, Artificial Sequence
  Corresponding array ID: plancto_4_5
acgttccgatgtattcctaccccgt

SEQ ID NO: 1501 - DNA, 25 bp, Artificial Sequence
  Corresponding array ID: plancto_4_6
tacgttccgatgtattcctaccccg

SEQ ID NO: 1502 - DNA, 25 bp, Artificial Sequence
  Corresponding array ID: plancto_4_7
gtacgttccgatgtattcctacccc

SEQ ID NO: 1503 - DNA, 25 bp, Artificial Sequence
  Corresponding array ID: plancto_4_8
ctacctaatatcgcatcggccgctc

SEQ ID NO: 1504 - DNA, 25 bp, Artificial Sequence
  Corresponding array ID: plancto_4_9
cgttccgatgtattcctaccccgtt

SEQ ID NO: 1505 - DNA, 25 bp, Artificial Sequence
  Corresponding array ID: plancto_4_10
gtttccacccactaatccgtgcatg

SEQ ID NO: 1506 - DNA, 25 bp, Artificial Sequence
  Corresponding array ID: plancto_4_11
ttccacccactaatccgtgcatgtc

SEQ ID NO: 1507 - DNA, 25 bp, Artificial Sequence
  Corresponding array ID: plancto_4_12
tccacccactaatccgtgcatgtca

SEQ ID NO: 1508 - DNA, 25 bp, Artificial Sequence
  Corresponding array ID: plancto_4_13
ccacccactaatccgtgcatgtcaa

SEQ ID NO: 1509 - DNA, 25 bp, Artificial Sequence
  Corresponding array ID: plancto_4_14
ggcagtaaacctttggtctctcgac

SEQ ID NO: 1510 - DNA, 25 bp, Artificial Sequence
  Corresponding array ID: plancto_4_15
ggtacgttccgatgtattcctaccc

SEQ ID NO: 1511 - DNA, 25 bp, Artificial Sequence
  Corresponding array ID: plancto_4_16
tgcgagcgtcatgaatgtttccacc

SEQ ID NO: 1512 - DNA, 25 bp, Artificial Sequence
  Corresponding array ID: plancto_4_17
gcgagcgtcatgaatgtttccaccc

SEQ ID NO: 1513 - DNA, 25 bp, Artificial Sequence
  Corresponding array ID: plancto_4_18
gagcgtcatgaatgtttccacccac

SEQ ID NO: 1514 - DNA, 25 bp, Artificial Sequence
  Corresponding array ID: plancto_4_19
cgagcgtcatgaatgtttccaccca

SEQ ID NO: 1515 - DNA, 25 bp, Artificial Sequence
  Corresponding array ID: plancto_4_20
cagttatgccccagtgaatcgcctt

SEQ ID NO: 1516 - DNA, 25 bp, Artificial Sequence
  Corresponding array ID: plancto_4_21
tcagttatgccccagtgaatcgcct

SEQ ID NO: 1517 - DNA, 25 bp, Artificial Sequence
  Corresponding array ID: plancto_4_22
agttatgccccagtgaatcgccttc

SEQ ID NO: 1518 - DNA, 25 bp, Artificial Sequence
  Corresponding array ID: plancto_4_23
gtcagttatgccccagtgaatcgcc

SEQ ID NO: 1519 - DNA, 25 bp, Artificial Sequence
  Corresponding array ID: plancto_4_24
gttatgccccagtgaatcgccttcg

SEQ ID NO: 1520 - DNA, 25 bp, Artificial Sequence
  Corresponding array ID: plancto_4_25
ctccactggatgttccattcacctc

SEQ ID NO: 1521 - DNA, 25 bp, Artificial Sequence
  Corresponding array ID: alpha_1_1
ccggccccttgcgggaagaaagcca

SEQ ID NO: 1522 - DNA, 25 bp, Artificial Sequence
  Corresponding array ID: alpha_1_2
cacctgtgcaccggccccttgcggg

SEQ ID NO: 1523 - DNA, 25 bp, Artificial Sequence
  Corresponding array ID: alpha_1_3
gcacctgtgcaccggccccttgcgg

SEQ ID NO: 1524 - DNA, 25 bp, Artificial Sequence
  Corresponding array ID: alpha_1_4
ctgtgcaccggccccttgcgggaag

SEQ ID NO: 1525 - DNA, 25 bp, Artificial Sequence
  Corresponding array ID: alpha_1_5
acctgtgcaccggccccttgcggga

SEQ ID NO: 1526 - DNA, 25 bp, Artificial Sequence
  Corresponding array ID: alpha_1_6
cctgtgcaccggccccttgcgggaa

SEQ ID NO: 1527 - DNA, 25 bp, Artificial Sequence
  Corresponding array ID: alpha_1_7
agcacctgtgcaccggccccttgcg

SEQ ID NO: 1528 - DNA, 25 bp, Artificial Sequence
  Corresponding array ID: alpha_1_8
cggccccttgcgggaagaaagccat

SEQ ID NO: 1529 - DNA, 25 bp, Artificial Sequence
  Corresponding array ID: alpha_1_9
gcaccggccccttgcgggaagaaag

SEQ ID NO: 1530 - DNA, 25 bp, Artificial Sequence
  Corresponding array ID: alpha_1_10
caccggccccttgcgggaagaaagc

SEQ ID NO: 1531 - DNA, 25 bp, Artificial Sequence
  Corresponding array ID: alpha_1_11
accggccccttgcgggaagaaagcc

SEQ ID NO: 1532 - DNA, 25 bp, Artificial Sequence
  Corresponding array ID: alpha_1_12
tgtgcaccggccccttgcgggaaga

SEQ ID NO: 1533 - DNA, 25 bp, Artificial Sequence
  Corresponding array ID: alpha_1_13
gtgcaccggccccttgcgggaagaa

SEQ ID NO: 1534 - DNA, 25 bp, Artificial Sequence
  Corresponding array ID: alpha_1_14
tgcaccggccccttgcgggaagaaa

SEQ ID NO: 1535 - DNA, 25 bp, Artificial Sequence
  Corresponding array ID: alpha_1_15
cagcacctgtgcaccggccccttgc

SEQ ID NO: 1536 - DNA, 25 bp, Artificial Sequence
  Corresponding array ID: alpha_1_16
ttgcgggaagaaagccatctctggc

SEQ ID NO: 1537 - DNA, 25 bp, Artificial Sequence
  Corresponding array ID: alpha_1_17
ggccccttgcgggaagaaagccatc

SEQ ID NO: 1538 - DNA, 25 bp, Artificial Sequence
  Corresponding array ID: alpha_1_18
ccttgcgggaagaaagccatctctg

SEQ ID NO: 1539 - DNA, 25 bp, Artificial Sequence
  Corresponding array ID: alpha_1_19
gcagcacctgtgcaccggccccttg

SEQ ID NO: 1540 - DNA, 25 bp, Artificial Sequence
  Corresponding array ID: alpha_1_20
tgcgggaagaaagccatctctggcg

SEQ ID NO: 1541 - DNA, 25 bp, Artificial Sequence
  Corresponding array ID: alpha_1_21
aaagccatctctggcgatcataccg

SEQ ID NO: 1542 - DNA, 25 bp, Artificial Sequence
  Corresponding array ID: alpha_1_22
gccccttgcgggaagaaagccatct

SEQ ID NO: 1543 - DNA, 25 bp, Artificial Sequence
  Corresponding array ID: alpha_1_23
aacagcaagctgcccaacggctagc

SEQ ID NO: 1544 - DNA, 25 bp, Artificial Sequence
  Corresponding array ID: alpha_1_24
catgcagcacctgtgcaccggcccc

SEQ ID NO: 1545 - DNA, 25 bp, Artificial Sequence
  Corresponding array ID: alpha_1_25
gcaagctgcccaacggctagcatcc

SEQ ID NO: 1546 - DNA, 25 bp, Artificial Sequence
  Corresponding array ID: alpha_2_1
gtgacccagaaagttgccttcgcat

SEQ ID NO: 1547 - DNA, 25 bp, Artificial Sequence
  Corresponding array ID: alpha_2_2
gtattcaccgcgacgcgctgattcg

SEQ ID NO: 1548 - DNA, 25 bp, Artificial Sequence
  Corresponding array ID: alpha_2_3
cgtattcaccgcgacgcgctgattc

SEQ ID NO: 1549 - DNA, 25 bp, Artificial Sequence
  Corresponding array ID: alpha_2_4
tattcaccgcgacgcgctgattcgc

SEQ ID NO: 1550 - DNA, 25 bp, Artificial Sequence
  Corresponding array ID: alpha_2_5
acgtattcaccgcgacgcgctgatt

SEQ ID NO: 1551 - DNA, 25 bp, Artificial Sequence
  Corresponding array ID: alpha_2_6
ggaacgtattcaccgcgacgcgctg

SEQ ID NO: 1552 - DNA, 25 bp, Artificial Sequence
  Corresponding array ID: alpha_2_7
ccgggaacgtattcaccgcgacgcg

SEQ ID NO: 1553 - DNA, 25 bp, Artificial Sequence
  Corresponding array ID: alpha_2_8
cgggaacgtattcaccgcgacgcgc

SEQ ID NO: 1554 - DNA, 25 bp, Artificial Sequence
  Corresponding array ID: alpha_2_9
gggaacgtattcaccgcgacgcgct

SEQ ID NO: 1555 - DNA, 25 bp, Artificial Sequence
  Corresponding array ID: alpha_2_10
aacgtattcaccgcgacgcgctgat

SEQ ID NO: 1556 - DNA, 25 bp, Artificial Sequence
  Corresponding array ID: alpha_2_11
gaacgtattcaccgcgacgcgctga

SEQ ID NO: 1557 - DNA, 25 bp, Artificial Sequence
  Corresponding array ID: alpha_2_12
cccgggaacgtattcaccgcgacgc

SEQ ID NO: 1558 - DNA, 25 bp, Artificial Sequence
  Corresponding array ID: alpha_2_13
attcaccgcgacgcgctgattcgcg

SEQ ID NO: 1559 - DNA, 25 bp, Artificial Sequence
  Corresponding array ID: alpha_2_14
ccgcgacgcgctgattcgcgattac

SEQ ID NO: 1560 - DNA, 25 bp, Artificial Sequence
  Corresponding array ID: alpha_2_15
caccgcgacgcgctgattcgcgatt

SEQ ID NO: 1561 - DNA, 25 bp, Artificial Sequence
  Corresponding array ID: alpha_2_16
cgcgacgcgctgattcgcgattact

SEQ ID NO: 1562 - DNA, 25 bp, Artificial Sequence
  Corresponding array ID: alpha_2_17
tcaccgcgacgcgctgattcgcgat

SEQ ID NO: 1563 - DNA, 25 bp, Artificial Sequence
  Corresponding array ID: alpha_2_18
accgcgacgcgctgattcgcgatta

SEQ ID NO: 1564 - DNA, 25 bp, Artificial Sequence
  Corresponding array ID: alpha_2_19
gcgacgcgctgattcgcgattacta

SEQ ID NO: 1565 - DNA, 25 bp, Artificial Sequence
  Corresponding array ID: alpha_2_20
ttcaccgcgacgcgctgattcgcga

SEQ ID NO: 1566 - DNA, 25 bp, Artificial Sequence
  Corresponding array ID: alpha_2_21
tcctcagtgtcagtagtgacccaga

SEQ ID NO: 1567 - DNA, 25 bp, Artificial Sequence
  Corresponding array ID: alpha_2_22
cccagaaagttgccttcgcatttgg

SEQ ID NO: 1568 - DNA, 25 bp, Artificial Sequence
  Corresponding array ID: alpha_2_23
agtgcgggctcatctttcggcgtat

SEQ ID NO: 1569 - DNA, 25 bp, Artificial Sequence
  Corresponding array ID: alpha_2_24
aagtgcgggctcatctttcggcgta

SEQ ID NO: 1570 - DNA, 25 bp, Artificial Sequence
  Corresponding array ID: alpha_2_25
gtgcgggctcatctttcggcgtata

SEQ ID NO: 1571 - DNA, 25 bp, Artificial Sequence
  Corresponding array ID: alpha_3_1
cacctgtatccaatccacccgaagt

SEQ ID NO: 1572 - DNA, 25 bp, Artificial Sequence
  Corresponding array ID: alpha_3_2
acctgtatccaatccacccgaagtg

SEQ ID NO: 1573 - DNA, 25 bp, Artificial Sequence
  Corresponding array ID: alpha_3_3
cctgtatccaatccacccgaagtga

SEQ ID NO: 1574 - DNA, 25 bp, Artificial Sequence
  Corresponding array ID: alpha_3_4
gcacctgtatccaatccacccgaag

SEQ ID NO: 1575 - DNA, 25 bp, Artificial Sequence
  Corresponding array ID: alpha_3_5
ggcagttccttcaaagttcccacca

SEQ ID NO: 1576 - DNA, 25 bp, Artificial Sequence
  Corresponding array ID: alpha_3_6
agcacctgtatccaatccacccgaa

SEQ ID NO: 1577 - DNA, 25 bp, Artificial Sequence
  Corresponding array ID: alpha_3_7
cggcagttccttcaaagttcccacc

SEQ ID NO: 1578 - DNA, 25 bp, Artificial Sequence
  Corresponding array ID: alpha_3_8
cagcacctgtatccaatccacccga

SEQ ID NO: 1579 - DNA, 25 bp, Artificial Sequence
  Corresponding array ID: alpha_3_9
ccggcagttccttcaaagttcccac

SEQ ID NO: 1580 - DNA, 25 bp, Artificial Sequence
  Corresponding array ID: alpha_3_10
gcagcacctgtatccaatccacccg

SEQ ID NO: 1581 - DNA, 25 bp, Artificial Sequence
  Corresponding array ID: alpha_3_11
tgcagcacctgtatccaatccaccc

SEQ ID NO: 1582 - DNA, 25 bp, Artificial Sequence
  Corresponding array ID: alpha_3_12
tcaccggcagttccttcaaagttcc

SEQ ID NO: 1583 - DNA, 25 bp, Artificial Sequence
  Corresponding array ID: alpha_3_13
cttacaaatccgcctacgctcgctt

SEQ ID NO: 1584 - DNA, 25 bp, Artificial Sequence
  Corresponding array ID: alpha_3_14
atgcagcacctgtatccaatccacc

SEQ ID NO: 1585 - DNA, 25 bp, Artificial Sequence
  Corresponding array ID: alpha_3_15
cgggcccatccaatagcgcataaag

SEQ ID NO: 1586 - DNA, 25 bp, Artificial Sequence
  Corresponding array ID: alpha_3_16
gggcccatccaatagcgcataaagc

SEQ ID NO: 1587 - DNA, 25 bp, Artificial Sequence
  Corresponding array ID: alpha_3_17
gcgggcccatccaatagcgcataaa

SEQ ID NO: 1588 - DNA, 25 bp, Artificial Sequence
  Corresponding array ID: alpha_3_18
acttacaaatccgcctacgctcgct

SEQ ID NO: 1589 - DNA, 25 bp, Artificial Sequence
  Corresponding array ID: alpha_3_19
cgcgggcccatccaatagcgcataa

SEQ ID NO: 1590 - DNA, 25 bp, Artificial Sequence
  Corresponding array ID: alpha_3_20
ggcccatccaatagcgcataaagct

SEQ ID NO: 1591 - DNA, 25 bp, Artificial Sequence
  Corresponding array ID: alpha_3_21
caccggcagttccttcaaagttccc

SEQ ID NO: 1592 - DNA, 25 bp, Artificial Sequence
  Corresponding array ID: alpha_3_22
accggcagttccttcaaagttccca

SEQ ID NO: 1593 - DNA, 25 bp, Artificial Sequence
  Corresponding array ID: alpha_3_23
aacttacaaatccgcctacgctcgc

SEQ ID NO: 1594 - DNA, 25 bp, Artificial Sequence
  Corresponding array ID: alpha_3_24
cgcataaagctttctcccgaaggac

SEQ ID NO: 1595 - DNA, 25 bp, Artificial Sequence
  Corresponding array ID: alpha_3_25
catgcagcacctgtatccaatccac

SEQ ID NO: 1596 - DNA, 25 bp, Artificial Sequence
  Corresponding array ID: roseo_1_1
ctctggaatccgcgacaagtatgtc

SEQ ID NO: 1597 - DNA, 25 bp, Artificial Sequence
  Corresponding array ID: roseo_1_2
tgcccctataaatagttggcgcacc

SEQ ID NO: 1598 - DNA, 25 bp, Artificial Sequence
  Corresponding array ID: roseo_1_3
ccctataaatagttggcgcaccacc

SEQ ID NO: 1599 - DNA, 25 bp, Artificial Sequence
  Corresponding array ID: roseo_1_4
cccctataaatagttggcgcaccac

SEQ ID NO: 1600 - DNA, 25 bp, Artificial Sequence
  Corresponding array ID: roseo_1_5
gcccctataaatagttggcgcacca

SEQ ID NO: 1601 - DNA, 25 bp, Artificial Sequence
  Corresponding array ID: roseo_1_6
cgtggttggctgcccctataaatag

SEQ ID NO: 1602 - DNA, 25 bp, Artificial Sequence
  Corresponding array ID: roseo_1_7
ctgcccctataaatagttggcgcac

SEQ ID NO: 1603 - DNA, 25 bp, Artificial Sequence
  Corresponding array ID: roseo_1_8
ccgtggttggctgcccctataaata

SEQ ID NO: 1604 - DNA, 25 bp, Artificial Sequence
  Corresponding array ID: roseo_1_9
tggctgcccctataaatagttggcg

SEQ ID NO: 1605 - DNA, 25 bp, Artificial Sequence
  Corresponding array ID: roseo_1_10
ggctgcccctataaatagttggcgc

SEQ ID NO: 1606 - DNA, 25 bp, Artificial Sequence
  Corresponding array ID: roseo_1_11
ggaatccgcgacaagtatgtcaagg

SEQ ID NO: 1607 - DNA, 25 bp, Artificial Sequence
  Corresponding array ID: roseo_1_12
gctgcccctataaatagttggcgca

SEQ ID NO: 1608 - DNA, 25 bp, Artificial Sequence
  Corresponding array ID: roseo_1_13
accgtggttggctgcccctataaat

SEQ ID NO: 1609 - DNA, 25 bp, Artificial Sequence
  Corresponding array ID: roseo_1_14
ccatctctggaatccgcgacaagta

SEQ ID NO: 1610 - DNA, 25 bp, Artificial Sequence
  Corresponding array ID: roseo_1_15
atagttggcgcaccaccttcgggta

SEQ ID NO: 1611 - DNA, 25 bp, Artificial Sequence
  Corresponding array ID: roseo_1_16
ggaatccatctctggaatccgcgac

SEQ ID NO: 1612 - DNA, 25 bp, Artificial Sequence
  Corresponding array ID: roseo_1_17
taccgtggttggctgcccctataaa

SEQ ID NO: 1613 - DNA, 25 bp, Artificial Sequence
  Corresponding array ID: roseo_1_18
gaatccgcgacaagtatgtcaaggg

SEQ ID NO: 1614 - DNA, 25 bp, Artificial Sequence
  Corresponding array ID: roseo_1_19
tccatctctggaatccgcgacaagt

SEQ ID NO: 1615 - DNA, 25 bp, Artificial Sequence
  Corresponding array ID: roseo_1_20
atccatctctggaatccgcgacaag

SEQ ID NO: 1616 - DNA, 25 bp, Artificial Sequence
  Corresponding array ID: roseo_1_21
tagttggcgcaccaccttcgggtag

SEQ ID NO: 1617 - DNA, 25 bp, Artificial Sequence
  Corresponding array ID: roseo_1_22
cctaccgtggttggctgcccctata

SEQ ID NO: 1618 - DNA, 25 bp, Artificial Sequence
  Corresponding array ID: roseo_1_23
ctaccgtggttggctgcccctataa

SEQ ID NO: 1619 - DNA, 25 bp, Artificial Sequence
  Corresponding array ID: roseo_1_24
acgtcgtccacaccttcctccggct

SEQ ID NO: 1620 - DNA, 25 bp, Artificial Sequence
  Corresponding array ID: roseo_1_25
gacgtcgtccacaccttcctccggc

SEQ ID NO: 1621 - DNA, 25 bp, Artificial Sequence
  Corresponding array ID: roseo_2_1
gtcaccgggtcaccgaagtgaaaac

SEQ ID NO: 1622 - DNA, 25 bp, Artificial Sequence
  Corresponding array ID: roseo_2_2
accgggtcaccgaagtgaaaaccag

SEQ ID NO: 1623 - DNA, 25 bp, Artificial Sequence
  Corresponding array ID: roseo_2_3
caccgggtcaccgaagtgaaaacca

SEQ ID NO: 1624 - DNA, 25 bp, Artificial Sequence
  Corresponding array ID: roseo_2_4
tcaccgggtcaccgaagtgaaaacc

SEQ ID NO: 1625 - DNA, 25 bp, Artificial Sequence
  Corresponding array ID: roseo_2_5
tgtcaccgggtcaccgaagtgaaaa

SEQ ID NO: 1626 - DNA, 25 bp, Artificial Sequence
  Corresponding array ID: roseo_2_6
ccgggtcaccgaagtgaaaaccaga

SEQ ID NO: 1627 - DNA, 25 bp, Artificial Sequence
  Corresponding array ID: roseo_2_7
agatctctctggcggtcccgggatg

SEQ ID NO: 1628 - DNA, 25 bp, Artificial Sequence
  Corresponding array ID: roseo_2_8
accagatctctctggcggtcccggg

SEQ ID NO: 1629 - DNA, 25 bp, Artificial Sequence
  Corresponding array ID: roseo_2_9
aaccagatctctctggcggtcccgg

SEQ ID NO: 1630 - DNA, 25 bp, Artificial Sequence
  Corresponding array ID: roseo_2_10
aaaccagatctctctggcggtcccg

SEQ ID NO: 1631 - DNA, 25 bp, Artificial Sequence
  Corresponding array ID: roseo_2_11
tctctggcggtcccgggatgtcaag

SEQ ID NO: 1632 - DNA, 25 bp, Artificial Sequence
  Corresponding array ID: roseo_2_12
atctctctggcggtcccgggatgtc

SEQ ID NO: 1633 - DNA, 25 bp, Artificial Sequence
  Corresponding array ID: roseo_2_13
gatctctctggcggtcccgggatgt

SEQ ID NO: 1634 - DNA, 25 bp, Artificial Sequence
  Corresponding array ID: roseo_2_14
cagatctctctggcggtcccgggat

SEQ ID NO: 1635 - DNA, 25 bp, Artificial Sequence
  Corresponding array ID: roseo_2_15
tctggcggtcccgggatgtcaaggg

SEQ ID NO: 1636 - DNA, 25 bp, Artificial Sequence
  Corresponding array ID: roseo_2_16
ctctggcggtcccgggatgtcaagg

SEQ ID NO: 1637 - DNA, 25 bp, Artificial Sequence
  Corresponding array ID: roseo_2_17
ccagatctctctggcggtcccggga

SEQ ID NO: 1638 - DNA, 25 bp, Artificial Sequence
  Corresponding array ID: roseo_2_18
tctctctggcggtcccgggatgtca

SEQ ID NO: 1639 - DNA, 25 bp, Artificial Sequence
  Corresponding array ID: roseo_2_19
ctctctggcggtcccgggatgtcaa

SEQ ID NO: 1640 - DNA, 25 bp, Artificial Sequence
  Corresponding array ID: roseo_2_20
ctggcggtcccgggatgtcaagggt

SEQ ID NO: 1641 - DNA, 25 bp, Artificial Sequence
  Corresponding array ID: roseo_2_21
acctgtcaccgggtcaccgaagtga

SEQ ID NO: 1642 - DNA, 25 bp, Artificial Sequence
  Corresponding array ID: roseo_2_22
cctgtcaccgggtcaccgaagtgaa

SEQ ID NO: 1643 - DNA, 25 bp, Artificial Sequence
  Corresponding array ID: roseo_2_23
ctgtcaccgggtcaccgaagtgaaa

SEQ ID NO: 1644 - DNA, 25 bp, Artificial Sequence
  Corresponding array ID: roseo_2_24
cgggtcaccgaagtgaaaaccagat

SEQ ID NO: 1645 - DNA, 25 bp, Artificial Sequence
  Corresponding array ID: roseo_2_25
aaaaccagatctctctggcggtccc

SEQ ID NO: 1646 - DNA, 25 bp, Artificial Sequence
  Corresponding array ID: roseo_3_1
gccgctacacccgaaggtgccgctc

SEQ ID NO: 1647 - DNA, 25 bp, Artificial Sequence
  Corresponding array ID: roseo_3_2
ctacacccgaaggtgccgctcgact

SEQ ID NO: 1648 - DNA, 25 bp, Artificial Sequence
  Corresponding array ID: roseo_3_3
gctacacccgaaggtgccgctcgac

SEQ ID NO: 1649 - DNA, 25 bp, Artificial Sequence
  Corresponding array ID: roseo_3_4
ccgctacacccgaaggtgccgctcg

SEQ ID NO: 1650 - DNA, 25 bp, Artificial Sequence
  Corresponding array ID: roseo_3_5
cgctacacccgaaggtgccgctcga

SEQ ID NO: 1651 - DNA, 25 bp, Artificial Sequence
  Corresponding array ID: roseo_3_6
cgccgctacacccgaaggtgccgct

SEQ ID NO: 1652 - DNA, 25 bp, Artificial Sequence
  Corresponding array ID: roseo_3_7
ccgccgctacacccgaaggtgccgc

SEQ ID NO: 1653 - DNA, 25 bp, Artificial Sequence
  Corresponding array ID: roseo_3_8
tacacccgaaggtgccgctcgactt

SEQ ID NO: 1654 - DNA, 25 bp, Artificial Sequence
  Corresponding array ID: roseo_3_9
tccgccgctacacccgaaggtgccg

SEQ ID NO: 1655 - DNA, 25 bp, Artificial Sequence
  Corresponding array ID: roseo_3_10
acacccgaaggtgccgctcgacttg

SEQ ID NO: 1656 - DNA, 25 bp, Artificial Sequence
  Corresponding array ID: roseo_3_11
gtccgccgctacacccgaaggtgcc

SEQ ID NO: 1657 - DNA, 25 bp, Artificial Sequence
  Corresponding array ID: roseo_3_12
acccgaaggtgccgctcgacttgca

SEQ ID NO: 1658 - DNA, 25 bp, Artificial Sequence
  Corresponding array ID: roseo_3_13
cacccgaaggtgccgctcgacttgc

SEQ ID NO: 1659 - DNA, 25 bp, Artificial Sequence
  Corresponding array ID: roseo_3_14
cgtccgccgctacacccgaaggtgc

SEQ ID NO: 1660 - DNA, 25 bp, Artificial Sequence
  Corresponding array ID: roseo_3_15
cacctggtctcttacgagaaaaccg

SEQ ID NO: 1661 - DNA, 25 bp, Artificial Sequence
  Corresponding array ID: roseo_3_16
ccaggagttttggaggccgttccag

SEQ ID NO: 1662 - DNA, 25 bp, Artificial Sequence
  Corresponding array ID: roseo_3_17
acctggtctcttacgagaaaaccgg

SEQ ID NO: 1663 - DNA, 25 bp, Artificial Sequence
  Corresponding array ID: roseo_3_18
ccggatctctccggcggtccaggga

SEQ ID NO: 1664 - DNA, 25 bp, Artificial Sequence
  Corresponding array ID: roseo_3_19
cccgaaggtgccgctcgacttgcat

SEQ ID NO: 1665 - DNA, 25 bp, Artificial Sequence
  Corresponding array ID: roseo_3_20
accaggagttttggaggccgttcca

SEQ ID NO: 1666 - DNA, 25 bp, Artificial Sequence
  Corresponding array ID: roseo_3_21
caggagttttggaggccgttccagg

SEQ ID NO: 1667 - DNA, 25 bp, Artificial Sequence
  Corresponding array ID: roseo_3_22
ccgaaggtgccgctcgacttgcatg

SEQ ID NO: 1668 - DNA, 25 bp, Artificial Sequence
  Corresponding array ID: roseo_3_23
ccgtccgccgctacacccgaaggtg

SEQ ID NO: 1669 - DNA, 25 bp, Artificial Sequence
  Corresponding array ID: roseo_3_24
aaaccggatctctccggcggtccag

SEQ ID NO: 1670 - DNA, 25 bp, Artificial Sequence
  Corresponding array ID: roseo_3_25
cctggtctcttacgagaaaaccgga

SEQ ID NO: 1671 - DNA, 25 bp, Artificial Sequence
  Corresponding array ID: roseo_4_1
cgtaccatctctggtagtagcacag

SEQ ID NO: 1672 - DNA, 25 bp, Artificial Sequence
  Corresponding array ID: roseo_4_2
ccatctctggtagtagcacaggatg

SEQ ID NO: 1673 - DNA, 25 bp, Artificial Sequence
  Corresponding array ID: roseo_4_3
gtaccatctctggtagtagcacagg

SEQ ID NO: 1674 - DNA, 25 bp, Artificial Sequence
  Corresponding array ID: roseo_4_4
ctggtagtagcacaggatgtcaagg

SEQ ID NO: 1675 - DNA, 25 bp, Artificial Sequence
  Corresponding array ID: roseo_4_5
tggtagtagcacaggatgtcaaggg

SEQ ID NO: 1676 - DNA, 25 bp, Artificial Sequence
  Corresponding array ID: roseo_4_6
gaagggaacgtaccatctctggtag

SEQ ID NO: 1677 - DNA, 25 bp, Artificial Sequence
  Corresponding array ID: roseo_4_7
ccttagagaagggcatattcccacg

SEQ ID NO: 1678 - DNA, 25 bp, Artificial Sequence
  Corresponding array ID: roseo_4_8
ggtagtagcacaggatgtcaagggt

SEQ ID NO: 1679 - DNA, 25 bp, Artificial Sequence
  Corresponding array ID: roseo_4_9
gggaacgtaccatctctggtagtag

SEQ ID NO: 1680 - DNA, 25 bp, Artificial Sequence
  Corresponding array ID: roseo_4_10
ggaacgtaccatctctggtagtagc

SEQ ID NO: 1681 - DNA, 25 bp, Artificial Sequence
  Corresponding array ID: roseo_4_11
cgaagggaacgtaccatctctggta

SEQ ID NO: 1682 - DNA, 25 bp, Artificial Sequence
  Corresponding array ID: roseo_4_12
ccgaagggaacgtaccatctctggt

SEQ ID NO: 1683 - DNA, 25 bp, Artificial Sequence
  Corresponding array ID: roseo_4_13
cgtccccgaagggaacgtaccatct

SEQ ID NO: 1684 - DNA, 25 bp, Artificial Sequence
  Corresponding array ID: roseo_4_14
ccccgaagggaacgtaccatctctg

SEQ ID NO: 1685 - DNA, 25 bp, Artificial Sequence
  Corresponding array ID: roseo_4_15
gtccccgaagggaacgtaccatctc

SEQ ID NO: 1686 - DNA, 25 bp, Artificial Sequence
  Corresponding array ID: roseo_4_16
gcgtccccgaagggaacgtaccatc

SEQ ID NO: 1687 - DNA, 25 bp, Artificial Sequence
  Corresponding array ID: roseo_4_17
actgcgtccccgaagggaacgtacc

SEQ ID NO: 1688 - DNA, 25 bp, Artificial Sequence
  Corresponding array ID: roseo_4_18
ctgcgtccccgaagggaacgtacca

SEQ ID NO: 1689 - DNA, 25 bp, Artificial Sequence
  Corresponding array ID: roseo_4_19
cccgaagggaacgtaccatctctgg

SEQ ID NO: 1690 - DNA, 25 bp, Artificial Sequence
  Corresponding array ID: roseo_4_20
tgcgtccccgaagggaacgtaccat

SEQ ID NO: 1691 - DNA, 25 bp, Artificial Sequence
  Corresponding array ID: roseo_4_21
cttagagaagggcatattcccacgc

SEQ ID NO: 1692 - DNA, 25 bp, Artificial Sequence
  Corresponding array ID: roseo_4_22
gaagggcgcgctcgacttgcatgta

SEQ ID NO: 1693 - DNA, 25 bp, Artificial Sequence
  Corresponding array ID: roseo_4_23
cactgcgtccccgaagggaacgtac

SEQ ID NO: 1694 - DNA, 25 bp, Artificial Sequence
  Corresponding array ID: roseo_4_24
tcactgcgtccccgaagggaacgta

SEQ ID NO: 1695 - DNA, 25 bp, Artificial Sequence
  Corresponding array ID: roseo_4_25
tccccgaagggaacgtaccatctct

SEQ ID NO: 1696 - DNA, 25 bp, Artificial Sequence
  Corresponding array ID: roseo_5_1
gtcactatgtcccgaaggaaagcct

SEQ ID NO: 1697 - DNA, 25 bp, Artificial Sequence
  Corresponding array ID: roseo_5_2
ccgaaggaaagcctgatctctcagg

SEQ ID NO: 1698 - DNA, 25 bp, Artificial Sequence
  Corresponding array ID: roseo_5_3
tgtcactatgtcccgaaggaaagcc

SEQ ID NO: 1699 - DNA, 25 bp, Artificial Sequence
  Corresponding array ID: roseo_5_4
tcccgaaggaaagcctgatctctca

SEQ ID NO: 1700 - DNA, 25 bp, Artificial Sequence
  Corresponding array ID: roseo_5_5
tcactatgtcccgaaggaaagcctg

SEQ ID NO: 1701 - DNA, 25 bp, Artificial Sequence
  Corresponding array ID: roseo_5_6
cccgaaggaaagcctgatctctcag

SEQ ID NO: 1702 - DNA, 25 bp, Artificial Sequence
  Corresponding array ID: roseo_5_7
ctgtcactatgtcccgaaggaaagc

SEQ ID NO: 1703 - DNA, 25 bp, Artificial Sequence
  Corresponding array ID: roseo_5_8
gtcccgaaggaaagcctgatctctc

SEQ ID NO: 1704 - DNA, 25 bp, Artificial Sequence
  Corresponding array ID: roseo_5_9
gcctgatctctcaggttgtcatagg

SEQ ID NO: 1705 - DNA, 25 bp, Artificial Sequence
  Corresponding array ID: roseo_5_10
tgactgactaatccgcctacgtacg

SEQ ID NO: 1706 - DNA, 25 bp, Artificial Sequence
  Corresponding array ID: roseo_5_11
ctgactgactaatccgcctacgtac

SEQ ID NO: 1707 - DNA, 25 bp, Artificial Sequence
  Corresponding array ID: roseo_5_12
cgaaggaaagcctgatctctcaggt

SEQ ID NO: 1708 - DNA, 25 bp, Artificial Sequence
  Corresponding array ID: roseo_5_13
cactatgtcccgaaggaaagcctga

SEQ ID NO: 1709 - DNA, 25 bp, Artificial Sequence
  Corresponding array ID: roseo_5_14
gcacctgtcactatgtcccgaagga

SEQ ID NO: 1710 - DNA, 25 bp, Artificial Sequence
  Corresponding array ID: roseo_5_15
cctgtcactatgtcccgaaggaaag

SEQ ID NO: 1711 - DNA, 25 bp, Artificial Sequence
  Corresponding array ID: roseo_5_16
ctatgtcccgaaggaaagcctgatc

SEQ ID NO: 1712 - DNA, 25 bp, Artificial Sequence
  Corresponding array ID: roseo_5_17
atgtcccgaaggaaagcctgatctc

SEQ ID NO: 1713 - DNA, 25 bp, Artificial Sequence
  Corresponding array ID: roseo_5_18
agcacctgtcactatgtcccgaagg

SEQ ID NO: 1714 - DNA, 25 bp, Artificial Sequence
  Corresponding array ID: roseo_5_19
cagcacctgtcactatgtcccgaag

SEQ ID NO: 1715 - DNA, 25 bp, Artificial Sequence
  Corresponding array ID: roseo_5_20
cctccgaagaggttagcgcacggcc

SEQ ID NO: 1716 - DNA, 25 bp, Artificial Sequence
  Corresponding array ID: roseo_5_21
tccgctgcctcctccgaagaggtta

SEQ ID NO: 1717 - DNA, 25 bp, Artificial Sequence
  Corresponding array ID: roseo_5_22
ccgctgcctcctccgaagaggttag

SEQ ID NO: 1718 - DNA, 25 bp, Artificial Sequence
  Corresponding array ID: roseo_5_23
tgtcccgaaggaaagcctgatctct

SEQ ID NO: 1719 - DNA, 25 bp, Artificial Sequence
  Corresponding array ID: roseo_5_24
cacctgtcactatgtcccgaaggaa

SEQ ID NO: 1720 - DNA, 25 bp, Artificial Sequence
  Corresponding array ID: roseo_5_25
gcagcacctgtcactatgtcccgaa

SEQ ID NO: 1721 - DNA, 25 bp, Artificial Sequence
  Corresponding array ID: roseo_6_1
cgataaaacctagtctcctaggcgg

SEQ ID NO: 1722 - DNA, 25 bp, Artificial Sequence
  Corresponding array ID: roseo_6_2
ccgaggctattccgaagcaaaaggt

SEQ ID NO: 1723 - DNA, 25 bp, Artificial Sequence
  Corresponding array ID: roseo_6_3
cccgaggctattccgaagcaaaagg

SEQ ID NO: 1724 - DNA, 25 bp, Artificial Sequence
  Corresponding array ID: roseo_6_4
aaaacctagtctcctaggcggtcag

SEQ ID NO: 1725 - DNA, 25 bp, Artificial Sequence
  Corresponding array ID: roseo_6_5
aaacctagtctcctaggcggtcaga

SEQ ID NO: 1726 - DNA, 25 bp, Artificial Sequence
  Corresponding array ID: roseo_6_6
tcccgaggctattccgaagcaaaag

SEQ ID NO: 1727 - DNA, 25 bp, Artificial Sequence
  Corresponding array ID: roseo_6_7
ctagtctcctaggcggtcagaggat

SEQ ID NO: 1728 - DNA, 25 bp, Artificial Sequence
  Corresponding array ID: roseo_6_8
aacctagtctcctaggcggtcagag

SEQ ID NO: 1729 - DNA, 25 bp, Artificial Sequence
  Corresponding array ID: roseo_6_9
cctagtctcctaggcggtcagagga

SEQ ID NO: 1730 - DNA, 25 bp, Artificial Sequence
  Corresponding array ID: roseo_6_10
tagtctcctaggcggtcagaggatg

SEQ ID NO: 1731 - DNA, 25 bp, Artificial Sequence
  Corresponding array ID: roseo_6_11
cctctcaaaccagctactgatcgca

SEQ ID NO: 1732 - DNA, 25 bp, Artificial Sequence
  Corresponding array ID: roseo_6_12
tcctctcaaaccagctactgatcgc

SEQ ID NO: 1733 - DNA, 25 bp, Artificial Sequence
  Corresponding array ID: roseo_6_13
ctctcaaaccagctactgatcgcag

SEQ ID NO: 1734 - DNA, 25 bp, Artificial Sequence
  Corresponding array ID: roseo_6_14
ctcaaaccagctactgatcgcagac

SEQ ID NO: 1735 - DNA, 25 bp, Artificial Sequence
  Corresponding array ID: roseo_6_15
cagctactgatcgcagacttggtag

SEQ ID NO: 1736 - DNA, 25 bp, Artificial Sequence
  Corresponding array ID: roseo_6_16
ccagctactgatcgcagacttggta

SEQ ID NO: 1737 - DNA, 25 bp, Artificial Sequence
  Corresponding array ID: roseo_6_17
ccatgcagcacctgtcactctgtat

SEQ ID NO: 1738 - DNA, 25 bp, Artificial Sequence
  Corresponding array ID: roseo_6_18
catgcagcacctgtcactctgtatc

SEQ ID NO: 1739 - DNA, 25 bp, Artificial Sequence
  Corresponding array ID: roseo_6_19
aaccagctactgatcgcagacttgg

SEQ ID NO: 1740 - DNA, 25 bp, Artificial Sequence
  Corresponding array ID: roseo_6_20
accagctactgatcgcagacttggt

SEQ ID NO: 1741 - DNA, 25 bp, Artificial Sequence
  Corresponding array ID: roseo_6_21
gccatgcagcacctgtcactctgta

SEQ ID NO: 1742 - DNA, 25 bp, Artificial Sequence
  Corresponding array ID: roseo_6_22
agtttcccgaggctattccgaagca

SEQ ID NO: 1743 - DNA, 25 bp, Artificial Sequence
  Corresponding array ID: roseo_6_23
gtttcccgaggctattccgaagcaa

SEQ ID NO: 1744 - DNA, 25 bp, Artificial Sequence
  Corresponding array ID: roseo_6_24
ggcggtcagaggatgtcaagggttg

SEQ ID NO: 1745 - DNA, 25 bp, Artificial Sequence
  Corresponding array ID: roseo_6_25
aggcggtcagaggatgtcaagggtt

SEQ ID NO: 1746 - DNA, 25 bp, Artificial Sequence
  Corresponding array ID: alpha_4_1
cgacaggcatgcctgccaacaacta

SEQ ID NO: 1747 - DNA, 25 bp, Artificial Sequence
  Corresponding array ID: alpha_4_2
ccgacaggcatgcctgccaacaact

SEQ ID NO: 1748 - DNA, 25 bp, Artificial Sequence
  Corresponding array ID: alpha_4_3
accgacaggcatgcctgccaacaac

SEQ ID NO: 1749 - DNA, 25 bp, Artificial Sequence
  Corresponding array ID: alpha_4_4
gacaggcatgcctgccaacaactag

SEQ ID NO: 1750 - DNA, 25 bp, Artificial Sequence
  Corresponding array ID: alpha_4_5
ccgtctgccactatatcgttcgact

SEQ ID NO: 1751 - DNA, 25 bp, Artificial Sequence
  Corresponding array ID: alpha_4_6
caccgacaggcatgcctgccaacaa

SEQ ID NO: 1752 - DNA, 25 bp, Artificial Sequence
  Corresponding array ID: alpha_4_7
cccgtctgccactatatcgttcgac

SEQ ID NO: 1753 - DNA, 25 bp, Artificial Sequence
  Corresponding array ID: alpha_4_8
caggcatgcctgccaacaactagct

SEQ ID NO: 1754 - DNA, 25 bp, Artificial Sequence
  Corresponding array ID: alpha_4_9
acaggcatgcctgccaacaactagc

SEQ ID NO: 1755 - DNA, 25 bp, Artificial Sequence
  Corresponding array ID: alpha_4_10
tcaccgacaggcatgcctgccaaca

SEQ ID NO: 1756 - DNA, 25 bp, Artificial Sequence
  Corresponding array ID: alpha_4_11
gcatgcctgccaacaactagctctc

SEQ ID NO: 1757 - DNA, 25 bp, Artificial Sequence
  Corresponding array ID: alpha_4_12
ggcatgcctgccaacaactagctct

SEQ ID NO: 1758 - DNA, 25 bp, Artificial Sequence
  Corresponding array ID: alpha_4_13
cacccgtctgccactatatcgttcg

SEQ ID NO: 1759 - DNA, 25 bp, Artificial Sequence
  Corresponding array ID: alpha_4_14
acccgtctgccactatatcgttcga

SEQ ID NO: 1760 - DNA, 25 bp, Artificial Sequence
  Corresponding array ID: alpha_4_15
gtcaccgacaggcatgcctgccaac

SEQ ID NO: 1761 - DNA, 25 bp, Artificial Sequence
  Corresponding array ID: alpha_4_16
aggcatgcctgccaacaactagctc

SEQ ID NO: 1762 - DNA, 25 bp, Artificial Sequence
  Corresponding array ID: alpha_4_17
ctcacccgtctgccactatatcgtt

SEQ ID NO: 1763 - DNA, 25 bp, Artificial Sequence
  Corresponding array ID: alpha_4_18
tcacccgtctgccactatatcgttc

SEQ ID NO: 1764 - DNA, 25 bp, Artificial Sequence
  Corresponding array ID: alpha_4_19
catgcctgccaacaactagctctca

SEQ ID NO: 1765 - DNA, 25 bp, Artificial Sequence
  Corresponding array ID: alpha_4_20
cctgccaacaactagctctcatcgt

SEQ ID NO: 1766 - DNA, 25 bp, Artificial Sequence
  Corresponding array ID: alpha_4_21
cgtcaccgacaggcatgcctgccaa

SEQ ID NO: 1767 - DNA, 25 bp, Artificial Sequence
  Corresponding array ID: alpha_4_22
ctcggtattccgctaacctctcctg

SEQ ID NO: 1768 - DNA, 25 bp, Artificial Sequence
  Corresponding array ID: alpha_4_23
actcacccgtctgccactatatcgt

SEQ ID NO: 1769 - DNA, 25 bp, Artificial Sequence
  Corresponding array ID: alpha_4_24
gcgtcaccgacaggcatgcctgcca

SEQ ID NO: 1770 - DNA, 25 bp, Artificial Sequence
  Corresponding array ID: alpha_4_25
tactcacccgtctgccactatatcg

SEQ ID NO: 1771 - DNA, 25 bp, Artificial Sequence
  Corresponding array ID: wolbach_1_1
gccaggacttcttctgtgagtaccg

SEQ ID NO: 1772 - DNA, 25 bp, Artificial Sequence
  Corresponding array ID: wolbach_1_2
agccaggacttcttctgtgagtacc

SEQ ID NO: 1773 - DNA, 25 bp, Artificial Sequence
  Corresponding array ID: wolbach_1_3
ccaggacttcttctgtgagtaccgt

SEQ ID NO: 1774 - DNA, 25 bp, Artificial Sequence
  Corresponding array ID: wolbach_1_4
cggagttagccaggacttcttctgt

SEQ ID NO: 1775 - DNA, 25 bp, Artificial Sequence
  Corresponding array ID: wolbach_1_5
ccggccgaaccgaccctatcccttc

SEQ ID NO: 1776 - DNA, 25 bp, Artificial Sequence
  Corresponding array ID: wolbach_1_6
acggagttagccaggacttcttctg

SEQ ID NO: 1777 - DNA, 25 bp, Artificial Sequence
  Corresponding array ID: wolbach_1_7
ggagttagccaggacttcttctgtg

SEQ ID NO: 1778 - DNA, 25 bp, Artificial Sequence
  Corresponding array ID: wolbach_1_8
caggacttcttctgtgagtaccgtc

SEQ ID NO: 1779 - DNA, 25 bp, Artificial Sequence
  Corresponding array ID: wolbach_1_9
ggcacggagttagccaggacttctt

SEQ ID NO: 1780 - DNA, 25 bp, Artificial Sequence
  Corresponding array ID: wolbach_1_10
cacggagttagccaggacttcttct

SEQ ID NO: 1781 - DNA, 25 bp, Artificial Sequence
  Corresponding array ID: wolbach_1_11
tggcacggagttagccaggacttct

SEQ ID NO: 1782 - DNA, 25 bp, Artificial Sequence
  Corresponding array ID: wolbach_1_12
gcacggagttagccaggacttcttc

SEQ ID NO: 1783 - DNA, 25 bp, Artificial Sequence
  Corresponding array ID: wolbach_1_13
cgcctcagcgtcagatttgaaccag

SEQ ID NO: 1784 - DNA, 25 bp, Artificial Sequence
  Corresponding array ID: wolbach_1_14
gcgcctcagcgtcagatttgaacca

SEQ ID NO: 1785 - DNA, 25 bp, Artificial Sequence
  Corresponding array ID: wolbach_1_15
ctggcacggagttagccaggacttc

SEQ ID NO: 1786 - DNA, 25 bp, Artificial Sequence
  Corresponding array ID: wolbach_1_16
ctgctggcacggagttagccaggac

SEQ ID NO: 1787 - DNA, 25 bp, Artificial Sequence
  Corresponding array ID: wolbach_1_17
gctggcacggagttagccaggactt

SEQ ID NO: 1788 - DNA, 25 bp, Artificial Sequence
  Corresponding array ID: wolbach_1_18
tgctggcacggagttagccaggact

SEQ ID NO: 1789 - DNA, 25 bp, Artificial Sequence
  Corresponding array ID: wolbach_1_19
cgcgcctcagcgtcagatttgaacc

SEQ ID NO: 1790 - DNA, 25 bp, Artificial Sequence
  Corresponding array ID: wolbach_1_20
gccttcgcgcctcagcgtcagattt

SEQ ID NO: 1791 - DNA, 25 bp, Artificial Sequence
  Corresponding array ID: wolbach_1_21
gcctcagcgtcagatttgaaccaga

SEQ ID NO: 1792 - DNA, 25 bp, Artificial Sequence
  Corresponding array ID: wolbach_1_22
tcgcgcctcagcgtcagatttgaac

SEQ ID NO: 1793 - DNA, 25 bp, Artificial Sequence
  Corresponding array ID: wolbach_1_23
catgcaacacctgtgtgaaacccgg

SEQ ID NO: 1794 - DNA, 25 bp, Artificial Sequence
  Corresponding array ID: wolbach_1_24
gactttgcagcccattgtagccacc

SEQ ID NO: 1795 - DNA, 25 bp, Artificial Sequence
  Corresponding array ID: wolbach_1_25
cgactttgcagcccattgtagccac

SEQ ID NO: 1796 - DNA, 25 bp, Artificial Sequence
  Corresponding array ID: rickett_1_1
tctctgcgatccgcgaccaccatgt

SEQ ID NO: 1797 - DNA, 25 bp, Artificial Sequence
  Corresponding array ID: rickett_1_2
atctctgcgatccgcgaccaccatg

SEQ ID NO: 1798 - DNA, 25 bp, Artificial Sequence
  Corresponding array ID: rickett_1_3
gtcagttgtagcccagatgaccgcc

SEQ ID NO: 1799 - DNA, 25 bp, Artificial Sequence
  Corresponding array ID: rickett_1_4
cagttgtagcccagatgaccgcctt

SEQ ID NO: 1800 - DNA, 25 bp, Artificial Sequence
  Corresponding array ID: rickett_1_5
tcagttgtagcccagatgaccgcct

SEQ ID NO: 1801 - DNA, 25 bp, Artificial Sequence
  Corresponding array ID: rickett_1_6
cgtcagttgtagcccagatgaccgc

SEQ ID NO: 1802 - DNA, 25 bp, Artificial Sequence
  Corresponding array ID: rickett_1_7
gttgtagcccagatgaccgccttcg

SEQ ID NO: 1803 - DNA, 25 bp, Artificial Sequence
  Corresponding array ID: rickett_1_8
agttgtagcccagatgaccgccttc

SEQ ID NO: 1804 - DNA, 25 bp, Artificial Sequence
  Corresponding array ID: rickett_1_9
catctctgcgatccgcgaccaccat

SEQ ID NO: 1805 - DNA, 25 bp, Artificial Sequence
  Corresponding array ID: rickett_1_10
gcgtcagttgtagcccagatgaccg

SEQ ID NO: 1806 - DNA, 25 bp, Artificial Sequence
  Corresponding array ID: rickett_1_11
agcatctctgcgatccgcgaccacc

SEQ ID NO: 1807 - DNA, 25 bp, Artificial Sequence
  Corresponding array ID: rickett_1_12
gcatctctgcgatccgcgaccacca

SEQ ID NO: 1808 - DNA, 25 bp, Artificial Sequence
  Corresponding array ID: rickett_1_13
ttgtagcccagatgaccgccttcgc

SEQ ID NO: 1809 - DNA, 25 bp, Artificial Sequence
  Corresponding array ID: rickett_1_14
agcgtcagttgtagcccagatgacc

SEQ ID NO: 1810 - DNA, 25 bp, Artificial Sequence
  Corresponding array ID: rickett_1_15
ccactaactaattggagcaagcccc

SEQ ID NO: 1811 - DNA, 25 bp, Artificial Sequence
  Corresponding array ID: rickett_1_16
gccactaactaattggagcaagccc

SEQ ID NO: 1812 - DNA, 25 bp, Artificial Sequence
  Corresponding array ID: rickett_1_17
caagccccaattagtccgttcgact

SEQ ID NO: 1813 - DNA, 25 bp, Artificial Sequence
  Corresponding array ID: rickett_1_18
ccgtcttgcttccctctgtaaacac

SEQ ID NO: 1814 - DNA, 25 bp, Artificial Sequence
  Corresponding array ID: rickett_1_19
ccgtctgccactaactaattggagc

SEQ ID NO: 1815 - DNA, 25 bp, Artificial Sequence
  Corresponding array ID: rickett_1_20
ctctgcgatccgcgaccaccatgtc

SEQ ID NO: 1816 - DNA, 25 bp, Artificial Sequence
  Corresponding array ID: rickett_1_21
gcaagccccaattagtccgttcgac

SEQ ID NO: 1817 - DNA, 25 bp, Artificial Sequence
  Corresponding array ID: rickett_1_22
agcaagccccaattagtccgttcga

SEQ ID NO: 1818 - DNA, 25 bp, Artificial Sequence
  Corresponding array ID: rickett_1_23
tgtagcccagatgaccgccttcgcc

SEQ ID NO: 1819 - DNA, 25 bp, Artificial Sequence
  Corresponding array ID: rickett_1_24
gagcaagccccaattagtccgttcg

SEQ ID NO: 1820 - DNA, 25 bp, Artificial Sequence
  Corresponding array ID: rickett_1_25
gaagaaaagcatctctgcgatccgc

SEQ ID NO: 1821 - DNA, 25 bp, Artificial Sequence
  Corresponding array ID: alpha_5_1
accaaagccctgtgggccctagcag

SEQ ID NO: 1822 - DNA, 25 bp, Artificial Sequence
  Corresponding array ID: alpha_5_2
caccaaagccctgtgggccctagca

SEQ ID NO: 1823 - DNA, 25 bp, Artificial Sequence
  Corresponding array ID: alpha_5_3
ccaaagccctgtgggccctagcagc

SEQ ID NO: 1824 - DNA, 25 bp, Artificial Sequence
  Corresponding array ID: alpha_5_4
accctatggtagatccccacgcgtt

SEQ ID NO: 1825 - DNA, 25 bp, Artificial Sequence
  Corresponding array ID: alpha_5_5
caccctatggtagatccccacgcgt

SEQ ID NO: 1826 - DNA, 25 bp, Artificial Sequence
  Corresponding array ID: alpha_5_6
gcaccctatggtagatccccacgcg

SEQ ID NO: 1827 - DNA, 25 bp, Artificial Sequence
  Corresponding array ID: alpha_5_7
ccgcaccctatggtagatccccacg

SEQ ID NO: 1828 - DNA, 25 bp, Artificial Sequence
  Corresponding array ID: alpha_5_8
cgcaccctatggtagatccccacgc

SEQ ID NO: 1829 - DNA, 25 bp, Artificial Sequence
  Corresponding array ID: alpha_5_9
tattccgcaccctatggtagatccc

SEQ ID NO: 1830 - DNA, 25 bp, Artificial Sequence
  Corresponding array ID: alpha_5_10
attccgcaccctatggtagatcccc

SEQ ID NO: 1831 - DNA, 25 bp, Artificial Sequence
  Corresponding array ID: alpha_5_11
tccgcaccctatggtagatccccac

SEQ ID NO: 1832 - DNA, 25 bp, Artificial Sequence
  Corresponding array ID: alpha_5_12
cgcaccagcttcgggttgatccaac

SEQ ID NO: 1833 - DNA, 25 bp, Artificial Sequence
  Corresponding array ID: alpha_5_13
ttccgcaccctatggtagatcccca

SEQ ID NO: 1834 - DNA, 25 bp, Artificial Sequence
  Corresponding array ID: alpha_5_14
ccaccaaagccctgtgggccctagc

SEQ ID NO: 1835 - DNA, 25 bp, Artificial Sequence
  Corresponding array ID: alpha_5_15
ccctatggtagatccccacgcgtta

SEQ ID NO: 1836 - DNA, 25 bp, Artificial Sequence
  Corresponding array ID: alpha_5_16
cctatggtagatccccacgcgttac

SEQ ID NO: 1837 - DNA, 25 bp, Artificial Sequence
  Corresponding array ID: alpha_5_17
gcgcaccagcttcgggttgatccaa

SEQ ID NO: 1838 - DNA, 25 bp, Artificial Sequence
  Corresponding array ID: alpha_5_18
gcaccagcttcgggttgatccaact

SEQ ID NO: 1839 - DNA, 25 bp, Artificial Sequence
  Corresponding array ID: alpha_5_19
agcgcaccagcttcgggttgatcca

SEQ ID NO: 1840 - DNA, 25 bp, Artificial Sequence
  Corresponding array ID: alpha_5_20
ctatggtagatccccacgcgttacg

SEQ ID NO: 1841 - DNA, 25 bp, Artificial Sequence
  Corresponding array ID: alpha_5_21
gccaccaaagccctgtgggccctag

SEQ ID NO: 1842 - DNA, 25 bp, Artificial Sequence
  Corresponding array ID: alpha_5_22
caccagcttcgggttgatccaactc

SEQ ID NO: 1843 - DNA, 25 bp, Artificial Sequence
  Corresponding array ID: alpha_5_23
tagcgcaccagcttcgggttgatcc

SEQ ID NO: 1844 - DNA, 25 bp, Artificial Sequence
  Corresponding array ID: alpha_5_24
caaagccctgtgggccctagcagct

SEQ ID NO: 1845 - DNA, 25 bp, Artificial Sequence
  Corresponding array ID: alpha_5_25
cgccaccaaagccctgtgggcccta

SEQ ID NO: 1846 - DNA, 25 bp, Artificial Sequence
  Corresponding array ID: alpha_6_1
gcgccactaaccccgaagcttcgtt

SEQ ID NO: 1847 - DNA, 25 bp, Artificial Sequence
  Corresponding array ID: alpha_6_2
cttcttgcgagtagctgcccactgt

SEQ ID NO: 1848 - DNA, 25 bp, Artificial Sequence
  Corresponding array ID: alpha_6_3
cccagcttgttgggccatgaggact

SEQ ID NO: 1849 - DNA, 25 bp, Artificial Sequence
  Corresponding array ID: alpha_6_4
atcttcttgcgagtagctgcccact

SEQ ID NO: 1850 - DNA, 25 bp, Artificial Sequence
  Corresponding array ID: alpha_6_5
tcttcttgcgagtagctgcccactg

SEQ ID NO: 1851 - DNA, 25 bp, Artificial Sequence
  Corresponding array ID: alpha_6_6
tagcccagcttgttgggccatgagg

SEQ ID NO: 1852 - DNA, 25 bp, Artificial Sequence
  Corresponding array ID: alpha_6_7
gccactaaccccgaagcttcgttcg

SEQ ID NO: 1853 - DNA, 25 bp, Artificial Sequence
  Corresponding array ID: alpha_6_8
gtagcccagcttgttgggccatgag

SEQ ID NO: 1854 - DNA, 25 bp, Artificial Sequence
  Corresponding array ID: alpha_6_9
cgccactaaccccgaagcttcgttc

SEQ ID NO: 1855 - DNA, 25 bp, Artificial Sequence
  Corresponding array ID: alpha_6_10
ttcttgcgagtagctgcccactgtc

SEQ ID NO: 1856 - DNA, 25 bp, Artificial Sequence
  Corresponding array ID: alpha_6_11
tagcatcttcttgcgagtagctgcc

SEQ ID NO: 1857 - DNA, 25 bp, Artificial Sequence
  Corresponding array ID: alpha_6_12
agcatcttcttgcgagtagctgccc

SEQ ID NO: 1858 - DNA, 25 bp, Artificial Sequence
  Corresponding array ID: alpha_6_13
gcccagcttgttgggccatgaggac

SEQ ID NO: 1859 - DNA, 25 bp, Artificial Sequence
  Corresponding array ID: alpha_6_14
cactaaccccgaagcttcgttcgac

SEQ ID NO: 1860 - DNA, 25 bp, Artificial Sequence
  Corresponding array ID: alpha_6_15
catcttcttgcgagtagctgcccac

SEQ ID NO: 1861 - DNA, 25 bp, Artificial Sequence
  Corresponding array ID: alpha_6_16
tgtagcccagcttgttgggccatga

SEQ ID NO: 1862 - DNA, 25 bp, Artificial Sequence
  Corresponding array ID: alpha_6_17
agcccagcttgttgggccatgagga

SEQ ID NO: 1863 - DNA, 25 bp, Artificial Sequence
  Corresponding array ID: alpha_6_18
ccactaaccccgaagcttcgttcga

SEQ ID NO: 1864 - DNA, 25 bp, Artificial Sequence
  Corresponding array ID: alpha_6_19
gcatcttcttgcgagtagctgccca

SEQ ID NO: 1865 - DNA, 25 bp, Artificial Sequence
  Corresponding array ID: alpha_6_20
gtgtagcccagcttgttgggccatg

SEQ ID NO: 1866 - DNA, 25 bp, Artificial Sequence
  Corresponding array ID: alpha_6_21
tgcgccactaaccccgaagcttcgt

SEQ ID NO: 1867 - DNA, 25 bp, Artificial Sequence
  Corresponding array ID: alpha_6_22
ctcaagcaccaagtgcccgaacagc

SEQ ID NO: 1868 - DNA, 25 bp, Artificial Sequence
  Corresponding array ID: alpha_6_23
ccagcttgttgggccatgaggactt

SEQ ID NO: 1869 - DNA, 25 bp, Artificial Sequence
  Corresponding array ID: alpha_6_24
actaaccccgaagcttcgttcgact

SEQ ID NO: 1870 - DNA, 25 bp, Artificial Sequence
  Corresponding array ID: alpha_6_25
tcttgcgagtagctgcccactgtca

SEQ ID NO: 1871 - DNA, 25 bp, Artificial Sequence
  Corresponding array ID: Bcereus_1
tccacctcgcggtcttgcagctctt

SEQ ID NO: 1872 - DNA, 25 bp, Artificial Sequence
  Corresponding array ID: Bcereus_2
gcctttcaatttcgaaccatgcggt

SEQ ID NO: 1873 - DNA, 25 bp, Artificial Sequence
  Corresponding array ID: Bcereus_3
ctcttaatccattcgctcgacttgc

SEQ ID NO: 1874 - DNA, 25 bp, Artificial Sequence
  Corresponding array ID: Bcereus_4
ccacctcgcggtcttgcagctcttt

SEQ ID NO: 1875 - DNA, 25 bp, Artificial Sequence
  Corresponding array ID: Bcereus_5
ctctgctcccgaaggagaagcccta

SEQ ID NO: 1876 - DNA, 25 bp, Artificial Sequence
  Corresponding array ID: Bcereus_6
ccgcctttcaatttcgaaccatgcg

SEQ ID NO: 1877 - DNA, 25 bp, Artificial Sequence
  Corresponding array ID: Bcereus_7
tctgctcccgaaggagaagccctat

SEQ ID NO: 1878 - DNA, 25 bp, Artificial Sequence
  Corresponding array ID: Bcereus_8
acctgtcactctgctcccgaaggag

SEQ ID NO: 1879 - DNA, 25 bp, Artificial Sequence
  Corresponding array ID: Bcereus_9
gctcttaatccattcgctcgacttg

SEQ ID NO: 1880 - DNA, 25 bp, Artificial Sequence
  Corresponding array ID: Bcereus_10
cgcctttcaatttcgaaccatgcgg

SEQ ID NO: 1881 - DNA, 25 bp, Artificial Sequence
  Corresponding array ID: Bcereus_11
actctgctcccgaaggagaagccct

SEQ ID NO: 1882 - DNA, 25 bp, Artificial Sequence
  Corresponding array ID: Bcereus_12
gctcccgaaggagaagccctatctc

SEQ ID NO: 1883 - DNA, 25 bp, Artificial Sequence
  Corresponding array ID: Bcereus_13
tcactctgctcccgaaggagaagcc

SEQ ID NO: 1884 - DNA, 25 bp, Artificial Sequence
  Corresponding array ID: Bcereus_14
tcttaatccattcgctcgacttgca

SEQ ID NO: 1885 - DNA, 25 bp, Artificial Sequence
  Corresponding array ID: Bcereus_15
ctgctcccgaaggagaagccctatc

SEQ ID NO: 1886 - DNA, 25 bp, Artificial Sequence
  Corresponding array ID: Bcereus_16
taatccattcgctcgacttgcatgt

SEQ ID NO: 1887 - DNA, 25 bp, Artificial Sequence
  Corresponding array ID: Bcereus_17
cactctgctcccgaaggagaagccc

SEQ ID NO: 1888 - DNA, 25 bp, Artificial Sequence
  Corresponding array ID: Bcereus_18
ggtcttgcagctctttgtaccgtcc

SEQ ID NO: 1889 - DNA, 25 bp, Artificial Sequence
  Corresponding array ID: Bcereus_19
tgctcccgaaggagaagccctatct

SEQ ID NO: 1890 - DNA, 25 bp, Artificial Sequence
  Corresponding array ID: Bcereus_20
cttaatccattcgctcgacttgcat

SEQ ID NO: 1891 - DNA, 25 bp, Artificial Sequence
  Corresponding array ID: Bcereus_21
ttaatccattcgctcgacttgcatg

SEQ ID NO: 1892 - DNA, 25 bp, Artificial Sequence
  Corresponding array ID: Bcereus_22
ctcccgaaggagaagccctatctct

SEQ ID NO: 1893 - DNA, 25 bp, Artificial Sequence
  Corresponding array ID: Bcereus_23
gtcactctgctcccgaaggagaagc

SEQ ID NO: 1894 - DNA, 25 bp, Artificial Sequence
  Corresponding array ID: Bcereus_24
cacctcgcggtcttgcagctctttg

SEQ ID NO: 1895 - DNA, 25 bp, Artificial Sequence
  Corresponding array ID: Bcereus_25
gtcttgcagctctttgtaccgtcca

SEQ ID NO: 1896 - DNA, 25 bp, Artificial Sequence
  Corresponding array ID: Bcereus_26
tgtcactctgctcccgaaggagaag

SEQ ID NO: 1897 - DNA, 25 bp, Artificial Sequence
  Corresponding array ID: Bcereus_27
tcccgaaggagaagccctatctcta

SEQ ID NO: 1898 - DNA, 25 bp, Artificial Sequence
  Corresponding array ID: Bcereus_28
cggtcttgcagctctttgtaccgtc

SEQ ID NO: 1899 - DNA, 25 bp, Artificial Sequence
  Corresponding array ID: Bcereus_29
tcaaaatgttatccggtattagccc

SEQ ID NO: 1900 - DNA, 25 bp, Artificial Sequence
  Corresponding array ID: Bcereus_30
cctgtcactctgctcccgaaggaga

SEQ ID NO: 1901 - DNA, 25 bp, Artificial Sequence
  Corresponding array ID: Bcereus_31
ttcaaaatgttatccggtattagcc

SEQ ID NO: 1902 - DNA, 25 bp, Artificial Sequence
  Corresponding array ID: Bcereus_32
cacctgtcactctgctcccgaagga

SEQ ID NO: 1903 - DNA, 25 bp, Artificial Sequence
  Corresponding array ID: Bcereus_33
tcttgcagctctttgtaccgtccat

SEQ ID NO: 1904 - DNA, 25 bp, Artificial Sequence
  Corresponding array ID: Bcereus_34
ctgtcactctgctcccgaaggagaa

SEQ ID NO: 1905 - DNA, 25 bp, Artificial Sequence
  Corresponding array ID: Bcereus_35
gcggtcttgcagctctttgtaccgt

SEQ ID NO: 1906 - DNA, 25 bp, Artificial Sequence
  Corresponding array ID: Bcereus_36
cgcggtcttgcagctctttgtaccg

SEQ ID NO: 1907 - DNA, 25 bp, Artificial Sequence
  Corresponding array ID: Bcereus_37
agctcttaatccattcgctcgactt

SEQ ID NO: 1908 - DNA, 25 bp, Artificial Sequence
  Corresponding array ID: Bcereus_38
acctcgcggtcttgcagctctttgt

SEQ ID NO: 1909 - DNA, 25 bp, Artificial Sequence
  Corresponding array ID: Bcereus_39
tcgcggtcttgcagctctttgtacc

SEQ ID NO: 1910 - DNA, 25 bp, Artificial Sequence
  Corresponding array ID: Bcereus_40
ctcgcggtcttgcagctctttgtac

SEQ ID NO: 1911 - DNA, 25 bp, Artificial Sequence
  Corresponding array ID: Bcereus_41
tgcaccacctgtcactctgctcccg

SEQ ID NO: 1912 - DNA, 25 bp, Artificial Sequence
  Corresponding array ID: Bcereus_42
atgcaccacctgtcactctgctccc

SEQ ID NO: 1913 - DNA, 25 bp, Artificial Sequence
  Corresponding array ID: Bcereus_43
accacctgtcactctgctcccgaag

SEQ ID NO: 1914 - DNA, 25 bp, Artificial Sequence
  Corresponding array ID: Bcereus_44
gcaccacctgtcactctgctcccga

SEQ ID NO: 1915 - DNA, 25 bp, Artificial Sequence
  Corresponding array ID: Bcereus_45
caccacctgtcactctgctcccgaa

SEQ ID NO: 1916 - DNA, 25 bp, Artificial Sequence
  Corresponding array ID: Bcereus_46
cataagagcaagctcttaatccatt

SEQ ID NO: 1917 - DNA, 25 bp, Artificial Sequence
  Corresponding array ID: Bcereus_47
cctcgcggtcttgcagctctttgta

SEQ ID NO: 1918 - DNA, 25 bp, Artificial Sequence
  Corresponding array ID: Bcereus_48
ccacctgtcactctgctcccgaagg

SEQ ID NO: 1919 - DNA, 25 bp, Artificial Sequence
  Corresponding array ID: Bcereus_49
aagagcaagctcttaatccattcgc

SEQ ID NO: 1920 - DNA, 25 bp, Artificial Sequence
  Corresponding array ID: Bcereus_50
cgaaggagaagccctatctctaggg

SEQ ID NO: 1921 - DNA, 25 bp, Artificial Sequence
  Corresponding array ID: Bcereus_51
aagctcttaatccattcgctcgact

SEQ ID NO: 1922 - DNA, 25 bp, Artificial Sequence
  Corresponding array ID: Bcereus_52
taagagcaagctcttaatccattcg

SEQ ID NO: 1923 - DNA, 25 bp, Artificial Sequence
  Corresponding array ID: Bcereus_53
ataagagcaagctcttaatccattc

SEQ ID NO: 1924 - DNA, 25 bp, Artificial Sequence
  Corresponding array ID: Bcereus_54
cccgaaggagaagccctatctctag

SEQ ID NO: 1925 - DNA, 25 bp, Artificial Sequence
  Corresponding array ID: Bcereus_55
ccgaaggagaagccctatctctagg

SEQ ID NO: 1926 - DNA, 25 bp, Artificial Sequence
  Corresponding array ID: Bcereus_56
caagctcttaatccattcgctcgac

SEQ ID NO: 1927 - DNA, 25 bp, Artificial Sequence
  Corresponding array ID: Bcereus_57
aaggagaagccctatctctagggtt

SEQ ID NO: 1928 - DNA, 25 bp, Artificial Sequence
  Corresponding array ID: Bcereus_58
gaaggagaagccctatctctagggt

SEQ ID NO: 1929 - DNA, 25 bp, Artificial Sequence
  Corresponding array ID: Bcereus_59
gcaagctcttaatccattcgctcga

SEQ ID NO: 1930 - DNA, 25 bp, Artificial Sequence
  Corresponding array ID: Bcereus_60
agcaagctcttaatccattcgctcg

SEQ ID NO: 1931 - DNA, 25 bp, Artificial Sequence
  Corresponding array ID: alpha_7_1
acatctctgtttccgcgaccgggat

SEQ ID NO: 1932 - DNA, 25 bp, Artificial Sequence
  Corresponding array ID: alpha_7_2
catctctgtttccgcgaccgggatg

SEQ ID NO: 1933 - DNA, 25 bp, Artificial Sequence
  Corresponding array ID: alpha_7_3
aaacatctctgtttccgcgaccggg

SEQ ID NO: 1934 - DNA, 25 bp, Artificial Sequence
  Corresponding array ID: alpha_7_4
gaaacatctctgtttccgcgaccgg

SEQ ID NO: 1935 - DNA, 25 bp, Artificial Sequence
  Corresponding array ID: alpha_7_5
agaaacatctctgtttccgcgaccg

SEQ ID NO: 1936 - DNA, 25 bp, Artificial Sequence
  Corresponding array ID: alpha_7_6
aacatctctgtttccgcgaccggga

SEQ ID NO: 1937 - DNA, 25 bp, Artificial Sequence
  Corresponding array ID: alpha_7_7
atctctgtttccgcgaccgggatgt

SEQ ID NO: 1938 - DNA, 25 bp, Artificial Sequence
  Corresponding array ID: alpha_7_8
ctgccactgtccacccgagcaagct

SEQ ID NO: 1939 - DNA, 25 bp, Artificial Sequence
  Corresponding array ID: alpha_7_9
ccactgtccacccgagcaagctcgg

SEQ ID NO: 1940 - DNA, 25 bp, Artificial Sequence
  Corresponding array ID: alpha_7_10
gccactgtccacccgagcaagctcg

SEQ ID NO: 1941 - DNA, 25 bp, Artificial Sequence
  Corresponding array ID: alpha_7_11
aaacctctaggtagatacccacgcg

SEQ ID NO: 1942 - DNA, 25 bp, Artificial Sequence
  Corresponding array ID: alpha_7_12
ccaaacctctaggtagatacccacg

SEQ ID NO: 1943 - DNA, 25 bp, Artificial Sequence
  Corresponding array ID: alpha_7_13
gtctgccactgtccacccgagcaag

SEQ ID NO: 1944 - DNA, 25 bp, Artificial Sequence
  Corresponding array ID: alpha_7_14
ccacccgagcaagctcgggtttctc

SEQ ID NO: 1945 - DNA, 25 bp, Artificial Sequence
  Corresponding array ID: alpha_7_15
tgccactgtccacccgagcaagctc

SEQ ID NO: 1946 - DNA, 25 bp, Artificial Sequence
  Corresponding array ID: alpha_7_16
caaacctctaggtagatacccacgc

SEQ ID NO: 1947 - DNA, 25 bp, Artificial Sequence
  Corresponding array ID: alpha_7_17
tctgccactgtccacccgagcaagc

SEQ ID NO: 1948 - DNA, 25 bp, Artificial Sequence
  Corresponding array ID: alpha_7_18
cgtctgccactgtccacccgagcaa

SEQ ID NO: 1949 - DNA, 25 bp, Artificial Sequence
  Corresponding array ID: alpha_7_19
tccgaacctctaggtagattcccac

SEQ ID NO: 1950 - DNA, 25 bp, Artificial Sequence
  Corresponding array ID: alpha_7_20
cacccgagcaagctcgggtttctcg

SEQ ID NO: 1951 - DNA, 25 bp, Artificial Sequence
  Corresponding array ID: alpha_7_21
acccgagcaagctcgggtttctcgt

SEQ ID NO: 1952 - DNA, 25 bp, Artificial Sequence
  Corresponding array ID: alpha_7_22
ccgtctgccactgtccacccgagca

SEQ ID NO: 1953 - DNA, 25 bp, Artificial Sequence
  Corresponding array ID: alpha_7_23
ccgaacctctaggtagattcccacg

SEQ ID NO: 1954 - DNA, 25 bp, Artificial Sequence
  Corresponding array ID: alpha_7_24
aacctctaggtagatacccacgcgt

SEQ ID NO: 1955 - DNA, 25 bp, Artificial Sequence
  Corresponding array ID: alpha_7_25
tccacccgagcaagctcgggtttct

SEQ ID NO: 1956 - DNA, 25 bp, Artificial Sequence
  Corresponding array ID: alpha_8_1
ctgccactgtccacccgagcaagct

SEQ ID NO: 1957 - DNA, 25 bp, Artificial Sequence
  Corresponding array ID: alpha_8_2
gccactgtccacccgagcaagctcg

SEQ ID NO: 1958 - DNA, 25 bp, Artificial Sequence
  Corresponding array ID: alpha_8_3
aaacctctaggtagatacccacgcg

SEQ ID NO: 1959 - DNA, 25 bp, Artificial Sequence
  Corresponding array ID: alpha_8_4
gtctgccactgtccacccgagcaag

SEQ ID NO: 1960 - DNA, 25 bp, Artificial Sequence
  Corresponding array ID: alpha_8_5
ccacccgagcaagctcgggtttctc

SEQ ID NO: 1961 - DNA, 25 bp, Artificial Sequence
  Corresponding array ID: alpha_8_6
tgccactgtccacccgagcaagctc

SEQ ID NO: 1962 - DNA, 25 bp, Artificial Sequence
  Corresponding array ID: alpha_8_7
caaacctctaggtagatacccacgc

SEQ ID NO: 1963 - DNA, 25 bp, Artificial Sequence
  Corresponding array ID: alpha_8_8
tctgccactgtccacccgagcaagc

SEQ ID NO: 1964 - DNA, 25 bp, Artificial Sequence
  Corresponding array ID: alpha_8_9
actgtccacccgagcaagctcgggt

SEQ ID NO: 1965 - DNA, 25 bp, Artificial Sequence
  Corresponding array ID: alpha_8_10
ccactgtccacccgagcaagctcgg

SEQ ID NO: 1966 - DNA, 25 bp, Artificial Sequence
  Corresponding array ID: alpha_8_11
ccaaacctctaggtagatacccacg

SEQ ID NO: 1967 - DNA, 25 bp, Artificial Sequence
  Corresponding array ID: alpha_8_12
gtccacccgagcaagctcgggtttc

SEQ ID NO: 1968 - DNA, 25 bp, Artificial Sequence
  Corresponding array ID: alpha_8_13
tccacccgagcaagctcgggtttct

SEQ ID NO: 1969 - DNA, 25 bp, Artificial Sequence
  Corresponding array ID: alpha_8_14
cgtctgccactgtccacccgagcaa

SEQ ID NO: 1970 - DNA, 25 bp, Artificial Sequence
  Corresponding array ID: alpha_8_15
tgtccacccgagcaagctcgggttt

SEQ ID NO: 1971 - DNA, 25 bp, Artificial Sequence
  Corresponding array ID: alpha_8_16
acctctaggtagatacccacgcgtt

SEQ ID NO: 1972 - DNA, 25 bp, Artificial Sequence
  Corresponding array ID: alpha_8_17
cacccgagcaagctcgggtttctcg

SEQ ID NO: 1973 - DNA, 25 bp, Artificial Sequence
  Corresponding array ID: alpha_8_18
taagccgtctgccactgtccacccg

SEQ ID NO: 1974 - DNA, 25 bp, Artificial Sequence
  Corresponding array ID: alpha_8_19
acccgagcaagctcgggtttctcgt

SEQ ID NO: 1975 - DNA, 25 bp, Artificial Sequence
  Corresponding array ID: alpha_8_20
ccgtctgccactgtccacccgagca

SEQ ID NO: 1976 - DNA, 25 bp, Artificial Sequence
  Corresponding array ID: alpha_8_21
aacctctaggtagatacccacgcgt

SEQ ID NO: 1977 - DNA, 25 bp, Artificial Sequence
  Corresponding array ID: alpha_8_22
gccgtctgccactgtccacccgagc

SEQ ID NO: 1978 - DNA, 25 bp, Artificial Sequence
  Corresponding array ID: alpha_8_23
tagatacccacgcgttactaagccg

SEQ ID NO: 1979 - DNA, 25 bp, Artificial Sequence
  Corresponding array ID: alpha_8_24
aagccgtctgccactgtccacccga

SEQ ID NO: 1980 - DNA, 25 bp, Artificial Sequence
  Corresponding array ID: alpha_8_25
gtagatacccacgcgttactaagcc

SEQ ID NO: 1981 - DNA, 25 bp, Artificial Sequence
  Corresponding array ID: alpha_9_1
tctccggcgaccaaactccccatgt

SEQ ID NO: 1982 - DNA, 25 bp, Artificial Sequence
  Corresponding array ID: alpha_9_2
cgtctccggcgaccaaactccccat

SEQ ID NO: 1983 - DNA, 25 bp, Artificial Sequence
  Corresponding array ID: alpha_9_3
gtctccggcgaccaaactccccatg

SEQ ID NO: 1984 - DNA, 25 bp, Artificial Sequence
  Corresponding array ID: alpha_9_4
ctccggcgaccaaactccccatgtc

SEQ ID NO: 1985 - DNA, 25 bp, Artificial Sequence
  Corresponding array ID: alpha_9_5
gccgtctccggcgaccaaactcccc

SEQ ID NO: 1986 - DNA, 25 bp, Artificial Sequence
  Corresponding array ID: alpha_9_6
tccggcgaccaaactccccatgtca

SEQ ID NO: 1987 - DNA, 25 bp, Artificial Sequence
  Corresponding array ID: alpha_9_7
ccgtctccggcgaccaaactcccca

SEQ ID NO: 1988 - DNA, 25 bp, Artificial Sequence
  Corresponding array ID: alpha_9_8
cgccgtctccggcgaccaaactccc

SEQ ID NO: 1989 - DNA, 25 bp, Artificial Sequence
  Corresponding array ID: alpha_9_9
ccggcgaccaaactccccatgtcaa

SEQ ID NO: 1990 - DNA, 25 bp, Artificial Sequence
  Corresponding array ID: alpha_9_10
acgccgtctccggcgaccaaactcc

SEQ ID NO: 1991 - DNA, 25 bp, Artificial Sequence
  Corresponding array ID: alpha_9_11
gaactgaaggacgccgtctccggcg

SEQ ID NO: 1992 - DNA, 25 bp, Artificial Sequence
  Corresponding array ID: alpha_9_12
cggcgaccaaactccccatgtcaag

SEQ ID NO: 1993 - DNA, 25 bp, Artificial Sequence
  Corresponding array ID: alpha_9_13
gtcggcagcctcccttacgggtcgg

SEQ ID NO: 1994 - DNA, 25 bp, Artificial Sequence
  Corresponding array ID: alpha_9_14
ggtcggcagcctcccttacgggtcg

SEQ ID NO: 1995 - DNA, 25 bp, Artificial Sequence
  Corresponding array ID: alpha_9_15
tggtcggcagcctcccttacgggtc

SEQ ID NO: 1996 - DNA, 25 bp, Artificial Sequence
  Corresponding array ID: alpha_9_16
tcggcagcctcccttacgggtcggc

SEQ ID NO: 1997 - DNA, 25 bp, Artificial Sequence
  Corresponding array ID: alpha_9_17
gtggtcggcagcctcccttacgggt

SEQ ID NO: 1998 - DNA, 25 bp, Artificial Sequence
  Corresponding array ID: alpha_9_18
cgtggtcggcagcctcccttacggg

SEQ ID NO: 1999 - DNA, 25 bp, Artificial Sequence
  Corresponding array ID: alpha_9_19
cggcagcctcccttacgggtcggcg

SEQ ID NO: 2000 - DNA, 25 bp, Artificial Sequence
  Corresponding array ID: alpha_9_20
cgcacctcagcgtcagatccggacc

SEQ ID NO: 2001 - DNA, 25 bp, Artificial Sequence
  Corresponding array ID: alpha_9_21
aatctttccccctcagggcttatcc

SEQ ID NO: 2002 - DNA, 25 bp, Artificial Sequence
  Corresponding array ID: alpha_9_22
cgaactgaaggacgccgtctccggc

SEQ ID NO: 2003 - DNA, 25 bp, Artificial Sequence
  Corresponding array ID: alpha_9_23
taccctcttccgatctctagcctag

SEQ ID NO: 2004 - DNA, 25 bp, Artificial Sequence
  Corresponding array ID: alpha_9_24
ggcagcctcccttacgggtcggcga

SEQ ID NO: 2005 - DNA, 25 bp, Artificial Sequence
  Corresponding array ID: alpha_9_25
ggcgaccaaactccccatgtcaagg

SEQ ID NO: 2006 - DNA, 25 bp, Artificial Sequence
  Corresponding array ID: alpha_10_1
cgcacctgagcgtcagatctagtcc

SEQ ID NO: 2007 - DNA, 25 bp, Artificial Sequence
  Corresponding array ID: alpha_10_2
tcgcacctgagcgtcagatctagtc

SEQ ID NO: 2008 - DNA, 25 bp, Artificial Sequence
  Corresponding array ID: alpha_10_3
cgtgcgccactctccagttcccgaa

SEQ ID NO: 2009 - DNA, 25 bp, Artificial Sequence
  Corresponding array ID: alpha_10_4
ccgtgcgccactctccagttcccga

SEQ ID NO: 2010 - DNA, 25 bp, Artificial Sequence
  Corresponding array ID: alpha_10_5
cccgtgcgccactctccagttcccg

SEQ ID NO: 2011 - DNA, 25 bp, Artificial Sequence
  Corresponding array ID: alpha_10_6
ctgagcgtcagatctagtccaggtg

SEQ ID NO: 2012 - DNA, 25 bp, Artificial Sequence
  Corresponding array ID: alpha_10_7
ttcgcacctgagcgtcagatctagt

SEQ ID NO: 2013 - DNA, 25 bp, Artificial Sequence
  Corresponding array ID: alpha_10_8
ccaaccgttatcccccactaagagg

SEQ ID NO: 2014 - DNA, 25 bp, Artificial Sequence
  Corresponding array ID: alpha_10_9
tccaaccgttatcccccactaagag

SEQ ID NO: 2015 - DNA, 25 bp, Artificial Sequence
  Corresponding array ID: alpha_10_10
gcacctgagcgtcagatctagtcca

SEQ ID NO: 2016 - DNA, 25 bp, Artificial Sequence
  Corresponding array ID: alpha_10_11
cctgagcgtcagatctagtccaggt

SEQ ID NO: 2017 - DNA, 25 bp, Artificial Sequence
  Corresponding array ID: alpha_10_12
gttagcccaccgtcttcgggtaaaa

SEQ ID NO: 2018 - DNA, 25 bp, Artificial Sequence
  Corresponding array ID: alpha_10_13
ccactaagaggtaggtccccacgcg

SEQ ID NO: 2019 - DNA, 25 bp, Artificial Sequence
  Corresponding array ID: alpha_10_14
tgagcgtcagatctagtccaggtgg

SEQ ID NO: 2020 - DNA, 25 bp, Artificial Sequence
  Corresponding array ID: alpha_10_15
atcccccactaagaggtaggtcccc

SEQ ID NO: 2021 - DNA, 25 bp, Artificial Sequence
  Corresponding array ID: alpha_10_16
gctttcacccctgactggcaagacc

SEQ ID NO: 2022 - DNA, 25 bp, Artificial Sequence
  Corresponding array ID: alpha_10_17
caaccgttatcccccactaagaggt

SEQ ID NO: 2023 - DNA, 25 bp, Artificial Sequence
  Corresponding array ID: alpha_10_18
gcgtcaccgaaatcgaaatcccgac

SEQ ID NO: 2024 - DNA, 25 bp, Artificial Sequence
  Corresponding array ID: alpha_10_19
tgcgtcaccgaaatcgaaatcccga

SEQ ID NO: 2025 - DNA, 25 bp, Artificial Sequence
  Corresponding array ID: alpha_10_20
cgtcaccgaaatcgaaatcccgaca

SEQ ID NO: 2026 - DNA, 25 bp, Artificial Sequence
  Corresponding array ID: alpha_10_21
ctgcgtcaccgaaatcgaaatcccg

SEQ ID NO: 2027 - DNA, 25 bp, Artificial Sequence
  Corresponding array ID: alpha_10_22
tttcgcacctgagcgtcagatctag

SEQ ID NO: 2028 - DNA, 25 bp, Artificial Sequence
  Corresponding array ID: alpha_10_23
ctttcacccctgactggcaagaccg

SEQ ID NO: 2029 - DNA, 25 bp, Artificial Sequence
  Corresponding array ID: alpha_10_24
ctaaaaggttagcccaccgtcttcg

SEQ ID NO: 2030 - DNA, 25 bp, Artificial Sequence
  Corresponding array ID: alpha_10_25
cccactaagaggtaggtccccacgc

SEQ ID NO: 2031 - DNA, 25 bp, Artificial Sequence
  Corresponding array ID: alpha_12_1
ccgtgcgccactctataaatagcgt

SEQ ID NO: 2032 - DNA, 25 bp, Artificial Sequence
  Corresponding array ID: alpha_12_2
cccgtgcgccactctataaatagcg

SEQ ID NO: 2033 - DNA, 25 bp, Artificial Sequence
  Corresponding array ID: alpha_12_3
ccaaccgttatcccgcagaaaaagg

SEQ ID NO: 2034 - DNA, 25 bp, Artificial Sequence
  Corresponding array ID: alpha_12_4
cccgcagaaaaaggcaggttcccac

SEQ ID NO: 2035 - DNA, 25 bp, Artificial Sequence
  Corresponding array ID: alpha_12_5
accgttatcccgcagaaaaaggcag

SEQ ID NO: 2036 - DNA, 25 bp, Artificial Sequence
  Corresponding array ID: alpha_12_6
caaccgttatcccgcagaaaaaggc

SEQ ID NO: 2037 - DNA, 25 bp, Artificial Sequence
  Corresponding array ID: alpha_12_7
cgtttccaaccgttatcccgcagaa

SEQ ID NO: 2038 - DNA, 25 bp, Artificial Sequence
  Corresponding array ID: alpha_12_8
ccgcagaaaaaggcaggttcccacg

SEQ ID NO: 2039 - DNA, 25 bp, Artificial Sequence
  Corresponding array ID: alpha_12_9
cgcagaaaaaggcaggttcccacgc

SEQ ID NO: 2040 - DNA, 25 bp, Artificial Sequence
  Corresponding array ID: alpha_12_10
ccgttatcccgcagaaaaaggcagg

SEQ ID NO: 2041 - DNA, 25 bp, Artificial Sequence
  Corresponding array ID: alpha_12_11
cgttatcccgcagaaaaaggcaggt

SEQ ID NO: 2042 - DNA, 25 bp, Artificial Sequence
  Corresponding array ID: alpha_12_12
acccgtgcgccactctataaatagc

SEQ ID NO: 2043 - DNA, 25 bp, Artificial Sequence
  Corresponding array ID: alpha_12_13
cacccgtgcgccactctataaatag

SEQ ID NO: 2044 - DNA, 25 bp, Artificial Sequence
  Corresponding array ID: alpha_12_14
tcccgcagaaaaaggcaggttccca

SEQ ID NO: 2045 - DNA, 25 bp, Artificial Sequence
  Corresponding array ID: alpha_12_15
gcagaaaaaggcaggttcccacgcg

SEQ ID NO: 2046 - DNA, 25 bp, Artificial Sequence
  Corresponding array ID: alpha_12_16
ggaaaccaaactccccatgtcaagg

SEQ ID NO: 2047 - DNA, 25 bp, Artificial Sequence
  Corresponding array ID: alpha_12_17
cctcctgcaagcaggttagctcacc

SEQ ID NO: 2048 - DNA, 25 bp, Artificial Sequence
  Corresponding array ID: alpha_12_18
tttcgcgcctcagcgtcaaaatcgg

SEQ ID NO: 2049 - DNA, 25 bp, Artificial Sequence
  Corresponding array ID: alpha_12_19
ttcgcgcctcagcgtcaaaatcgga

SEQ ID NO: 2050 - DNA, 25 bp, Artificial Sequence
  Corresponding array ID: alpha_12_20
actccccatgtcaaggactggtaag

SEQ ID NO: 2051 - DNA, 25 bp, Artificial Sequence
  Corresponding array ID: alpha_12_21
gcctcctgcaagcaggttagctcac

SEQ ID NO: 2052 - DNA, 25 bp, Artificial Sequence
  Corresponding array ID: alpha_12_22
cagaaaaaggcaggttcccacgcgt

SEQ ID NO: 2053 - DNA, 25 bp, Artificial Sequence
  Corresponding array ID: alpha_12_23
tccggcggacctttcccccgtaggg

SEQ ID NO: 2054 - DNA, 25 bp, Artificial Sequence
  Corresponding array ID: alpha_12_24
tatcccgcagaaaaaggcaggttcc

SEQ ID NO: 2055 - DNA, 25 bp, Artificial Sequence
  Corresponding array ID: alpha_12_25
cccctctttctccggcggacctttc

SEQ ID NO: 2056 - DNA, 25 bp, Artificial Sequence
  Corresponding array ID: alpha_13_1
tctaactgttcaagcagcctgcgag

SEQ ID NO: 2057 - DNA, 25 bp, Artificial Sequence
  Corresponding array ID: alpha_13_2
ctaactgttcaagcagcctgcgagc

SEQ ID NO: 2058 - DNA, 25 bp, Artificial Sequence
  Corresponding array ID: alpha_13_3
taactgttcaagcagcctgcgagcc

SEQ ID NO: 2059 - DNA, 25 bp, Artificial Sequence
  Corresponding array ID: alpha_13_4
gtctaactgttcaagcagcctgcga

SEQ ID NO: 2060 - DNA, 25 bp, Artificial Sequence
  Corresponding array ID: alpha_13_5
cgctcctcagcgtcagaaaatagcc

SEQ ID NO: 2061 - DNA, 25 bp, Artificial Sequence
  Corresponding array ID: alpha_13_6
gctcctcagcgtcagaaaatagcca

SEQ ID NO: 2062 - DNA, 25 bp, Artificial Sequence
  Corresponding array ID: alpha_13_7
tcgctcctcagcgtcagaaaatagc

SEQ ID NO: 2063 - DNA, 25 bp, Artificial Sequence
  Corresponding array ID: alpha_13_8
cgtctaactgttcaagcagcctgcg

SEQ ID NO: 2064 - DNA, 25 bp, Artificial Sequence
  Corresponding array ID: alpha_13_9
aactgttcaagcagcctgcgagccc

SEQ ID NO: 2065 - DNA, 25 bp, Artificial Sequence
  Corresponding array ID: alpha_13_10
cacgtctaactgttcaagcagcctg

SEQ ID NO: 2066 - DNA, 25 bp, Artificial Sequence
  Corresponding array ID: alpha_13_11
acgtctaactgttcaagcagcctgc

SEQ ID NO: 2067 - DNA, 25 bp, Artificial Sequence
  Corresponding array ID: alpha_13_12
actgttcaagcagcctgcgagccct

SEQ ID NO: 2068 - DNA, 25 bp, Artificial Sequence
  Corresponding array ID: alpha_13_13
ccggggatttcacgtctaactgttc

SEQ ID NO: 2069 - DNA, 25 bp, Artificial Sequence
  Corresponding array ID: alpha_13_14
ctcctcagcgtcagaaaatagccag

SEQ ID NO: 2070 - DNA, 25 bp, Artificial Sequence
  Corresponding array ID: alpha_13_15
ttcaagcagcctgcgagccctttac

SEQ ID NO: 2071 - DNA, 25 bp, Artificial Sequence
  Corresponding array ID: alpha_13_16
tgttcaagcagcctgcgagcccttt

SEQ ID NO: 2072 - DNA, 25 bp, Artificial Sequence
  Corresponding array ID: alpha_13_17
ctgttcaagcagcctgcgagccctt

SEQ ID NO: 2073 - DNA, 25 bp, Artificial Sequence
  Corresponding array ID: alpha_13_18
gttcaagcagcctgcgagcccttta

SEQ ID NO: 2074 - DNA, 25 bp, Artificial Sequence
  Corresponding array ID: alpha_13_19
cggcattgctggatcagagttgcct

SEQ ID NO: 2075 - DNA, 25 bp, Artificial Sequence
  Corresponding array ID: alpha_13_20
ggcattgctggatcagagttgcctc

SEQ ID NO: 2076 - DNA, 25 bp, Artificial Sequence
  Corresponding array ID: alpha_13_21
cgcggcattgctggatcagagttgc

SEQ ID NO: 2077 - DNA, 25 bp, Artificial Sequence
  Corresponding array ID: alpha_13_22
gcattgctggatcagagttgcctcc

SEQ ID NO: 2078 - DNA, 25 bp, Artificial Sequence
  Corresponding array ID: alpha_13_23
gcggcattgctggatcagagttgcc

SEQ ID NO: 2079 - DNA, 25 bp, Artificial Sequence
  Corresponding array ID: alpha_13_24
cccggggatttcacgtctaactgtt

SEQ ID NO: 2080 - DNA, 25 bp, Artificial Sequence
  Corresponding array ID: alpha_13_25
acgcggcattgctggatcagagttg

SEQ ID NO: 2081 - DNA, 25 bp, Artificial Sequence
  Corresponding array ID: delta_1_1
ccgaactacgaactgctttctggga

SEQ ID NO: 2082 - DNA, 25 bp, Artificial Sequence
  Corresponding array ID: delta_1_2
tccgaactacgaactgctttctggg

SEQ ID NO: 2083 - DNA, 25 bp, Artificial Sequence
  Corresponding array ID: delta_1_3
ttgctgcggcacagcaggggtcaat

SEQ ID NO: 2084 - DNA, 25 bp, Artificial Sequence
  Corresponding array ID: delta_1_4
gtttgctgcggcacagcaggggtca

SEQ ID NO: 2085 - DNA, 25 bp, Artificial Sequence
  Corresponding array ID: delta_1_5
tttgctgcggcacagcaggggtcaa

SEQ ID NO: 2086 - DNA, 25 bp, Artificial Sequence
  Corresponding array ID: delta_1_6
ttgcccaacgacttctggtacaacc

SEQ ID NO: 2087 - DNA, 25 bp, Artificial Sequence
  Corresponding array ID: delta_1_7
ggtttgcccaacgacttctggtaca

SEQ ID NO: 2088 - DNA, 25 bp, Artificial Sequence
  Corresponding array ID: delta_1_8
tccccgaagggtttgcccaacgact

SEQ ID NO: 2089 - DNA, 25 bp, Artificial Sequence
  Corresponding array ID: delta_1_9
ccccgaagggtttgcccaacgactt

SEQ ID NO: 2090 - DNA, 25 bp, Artificial Sequence
  Corresponding array ID: delta_1_10
ccgaagggtttgcccaacgacttct

SEQ ID NO: 2091 - DNA, 25 bp, Artificial Sequence
  Corresponding array ID: delta_1_11
cccgaagggtttgcccaacgacttc

SEQ ID NO: 2092 - DNA, 25 bp, Artificial Sequence
  Corresponding array ID: delta_1_12
cccgggctttcacacctgacttaaa

SEQ ID NO: 2093 - DNA, 25 bp, Artificial Sequence
  Corresponding array ID: delta_1_13
gcttccttcagtggtaccgtcaaca

SEQ ID NO: 2094 - DNA, 25 bp, Artificial Sequence
  Corresponding array ID: delta_1_14
aggcgcctgcatccccgaagggttt

SEQ ID NO: 2095 - DNA, 25 bp, Artificial Sequence
  Corresponding array ID: delta_1_15
ggcgcctgcatccccgaagggtttg

SEQ ID NO: 2096 - DNA, 25 bp, Artificial Sequence
  Corresponding array ID: delta_1_16
gcgcctgcatccccgaagggtttgc

SEQ ID NO: 2097 - DNA, 25 bp, Artificial Sequence
  Corresponding array ID: delta_1_17
gcatccccgaagggtttgcccaacg

SEQ ID NO: 2098 - DNA, 25 bp, Artificial Sequence
  Corresponding array ID: delta_1_18
atccccgaagggtttgcccaacgac

SEQ ID NO: 2099 - DNA, 25 bp, Artificial Sequence
  Corresponding array ID: delta_1_19
catccccgaagggtttgcccaacga

SEQ ID NO: 2100 - DNA, 25 bp, Artificial Sequence
  Corresponding array ID: delta_1_20
accttaggcgcctgcatccccgaag

SEQ ID NO: 2101 - DNA, 25 bp, Artificial Sequence
  Corresponding array ID: delta_1_21
ccttaggcgcctgcatccccgaagg

SEQ ID NO: 2102 - DNA, 25 bp, Artificial Sequence
  Corresponding array ID: delta_1_22
taccttaggcgcctgcatccccgaa

SEQ ID NO: 2103 - DNA, 25 bp, Artificial Sequence
  Corresponding array ID: delta_1_23
ataccttaggcgcctgcatccccga

SEQ ID NO: 2104 - DNA, 25 bp, Artificial Sequence
  Corresponding array ID: delta_1_24
cttaggcgcctgcatccccgaaggg

SEQ ID NO: 2105 - DNA, 25 bp, Artificial Sequence
  Corresponding array ID: delta_1_25
cataccttaggcgcctgcatccccg

SEQ ID NO: 2106 - DNA, 25 bp, Artificial Sequence
  Corresponding array ID: delta_2_1
ctccagtctttcgataggattcccg

SEQ ID NO: 2107 - DNA, 25 bp, Artificial Sequence
  Corresponding array ID: delta_2_2
ggccacccttgatccaaaaacccga

SEQ ID NO: 2108 - DNA, 25 bp, Artificial Sequence
  Corresponding array ID: delta_2_3
aggccacccttgatccaaaaacccg

SEQ ID NO: 2109 - DNA, 25 bp, Artificial Sequence
  Corresponding array ID: delta_2_4
aagggcactccagtctttcgatagg

SEQ ID NO: 2110 - DNA, 25 bp, Artificial Sequence
  Corresponding array ID: delta_2_5
gaggccacccttgatccaaaaaccc

SEQ ID NO: 2111 - DNA, 25 bp, Artificial Sequence
  Corresponding array ID: delta_2_6
gaagggcactccagtctttcgatag

SEQ ID NO: 2112 - DNA, 25 bp, Artificial Sequence
  Corresponding array ID: delta_2_7
accctagcaagctagagtgttctcg

SEQ ID NO: 2113 - DNA, 25 bp, Artificial Sequence
  Corresponding array ID: delta_2_8
catgtagaggccacccttgatccaa

SEQ ID NO: 2114 - DNA, 25 bp, Artificial Sequence
  Corresponding array ID: delta_2_9
agaggccacccttgatccaaaaacc

SEQ ID NO: 2115 - DNA, 25 bp, Artificial Sequence
  Corresponding array ID: delta_2_10
acatgtagaggccacccttgatcca

SEQ ID NO: 2116 - DNA, 25 bp, Artificial Sequence
  Corresponding array ID: delta_2_11
tacatgtagaggccacccttgatcc

SEQ ID NO: 2117 - DNA, 25 bp, Artificial Sequence
  Corresponding array ID: delta_2_12
ccccgaagggcactccagtctttcg

SEQ ID NO: 2118 - DNA, 25 bp, Artificial Sequence
  Corresponding array ID: delta_2_13
ccctagcaagctagagtgttctcgt

SEQ ID NO: 2119 - DNA, 25 bp, Artificial Sequence
  Corresponding array ID: delta_2_14
gcttacatgtagaggccacccttga

SEQ ID NO: 2120 - DNA, 25 bp, Artificial Sequence
  Corresponding array ID: delta_2_15
gggcactccagtctttcgataggat

SEQ ID NO: 2121 - DNA, 25 bp, Artificial Sequence
  Corresponding array ID: delta_2_16
ccgaagggcactccagtctttcgat

SEQ ID NO: 2122 - DNA, 25 bp, Artificial Sequence
  Corresponding array ID: delta_2_17
cgaagggcactccagtctttcgata

SEQ ID NO: 2123 - DNA, 25 bp, Artificial Sequence
  Corresponding array ID: delta_2_18
agggcactccagtctttcgatagga

SEQ ID NO: 2124 - DNA, 25 bp, Artificial Sequence
  Corresponding array ID: delta_2_19
cccgaagggcactccagtctttcga

SEQ ID NO: 2125 - DNA, 25 bp, Artificial Sequence
  Corresponding array ID: delta_2_20
ccagtctttcgataggattcccggg

SEQ ID NO: 2126 - DNA, 25 bp, Artificial Sequence
  Corresponding array ID: delta_2_21
tccagtctttcgataggattcccgg

SEQ ID NO: 2127 - DNA, 25 bp, Artificial Sequence
  Corresponding array ID: delta_2_22
gtctttcgataggattcccgggatg

SEQ ID NO: 2128 - DNA, 25 bp, Artificial Sequence
  Corresponding array ID: delta_2_23
ctttcgataggattcccgggatgtc

SEQ ID NO: 2129 - DNA, 25 bp, Artificial Sequence
  Corresponding array ID: delta_2_24
cagtctttcgataggattcccggga

SEQ ID NO: 2130 - DNA, 25 bp, Artificial Sequence
  Corresponding array ID: delta_2_25
gggctccccgaagggcactccagtc

SEQ ID NO: 2131 - DNA, 25 bp, Artificial Sequence
  Corresponding array ID: delta_3_1
ggcacagaaagggtcaacacttcct

SEQ ID NO: 2132 - DNA, 25 bp, Artificial Sequence
  Corresponding array ID: delta_3_2
tcggcacagaaagggtcaacacttc

SEQ ID NO: 2133 - DNA, 25 bp, Artificial Sequence
  Corresponding array ID: delta_3_3
cggcacagaaagggtcaacacttcc

SEQ ID NO: 2134 - DNA, 25 bp, Artificial Sequence
  Corresponding array ID: delta_3_4
cttcggcacagaaagggtcaacact

SEQ ID NO: 2135 - DNA, 25 bp, Artificial Sequence
  Corresponding array ID: delta_3_5
cactttactctcccgacgaatcgga

SEQ ID NO: 2136 - DNA, 25 bp, Artificial Sequence
  Corresponding array ID: delta_3_6
ccactttactctcccgacgaatcgg

SEQ ID NO: 2137 - DNA, 25 bp, Artificial Sequence
  Corresponding array ID: delta_3_7
gcttcggcacagaaagggtcaacac

SEQ ID NO: 2138 - DNA, 25 bp, Artificial Sequence
  Corresponding array ID: delta_3_8
ctctcccgacgaatcggaatttctc

SEQ ID NO: 2139 - DNA, 25 bp, Artificial Sequence
  Corresponding array ID: delta_3_9
ccgacgaatcggaatttctcgttcg

SEQ ID NO: 2140 - DNA, 25 bp, Artificial Sequence
  Corresponding array ID: delta_3_10
gccactttactctcccgacgaatcg

SEQ ID NO: 2141 - DNA, 25 bp, Artificial Sequence
  Corresponding array ID: delta_3_11
agcttcggcacagaaagggtcaaca

SEQ ID NO: 2142 - DNA, 25 bp, Artificial Sequence
  Corresponding array ID: delta_3_12
actctcacgagttcgctaccctttg

SEQ ID NO: 2143 - DNA, 25 bp, Artificial Sequence
  Corresponding array ID: delta_3_13
tctcccgacgaatcggaatttctcg

SEQ ID NO: 2144 - DNA, 25 bp, Artificial Sequence
  Corresponding array ID: delta_3_14
tagcttcggcacagaaagggtcaac

SEQ ID NO: 2145 - DNA, 25 bp, Artificial Sequence
  Corresponding array ID: delta_3_15
ctctcacgagttcgctaccctttgt

SEQ ID NO: 2146 - DNA, 25 bp, Artificial Sequence
  Corresponding array ID: delta_3_16
gtgctggttacacccgaaggcaatc

SEQ ID NO: 2147 - DNA, 25 bp, Artificial Sequence
  Corresponding array ID: delta_3_17
cgccactttactctcccgacgaatc

SEQ ID NO: 2148 - DNA, 25 bp, Artificial Sequence
  Corresponding array ID: delta_3_18
ctcccgacgaatcggaatttctcgt

SEQ ID NO: 2149 - DNA, 25 bp, Artificial Sequence
  Corresponding array ID: delta_3_19
cttactctcacgagttcgctaccct

SEQ ID NO: 2150 - DNA, 25 bp, Artificial Sequence
  Corresponding array ID: delta_3_20
tgtgctggttacacccgaaggcaat

SEQ ID NO: 2151 - DNA, 25 bp, Artificial Sequence
  Corresponding array ID: delta_3_21
ctcacgagttcgctaccctttgtac

SEQ ID NO: 2152 - DNA, 25 bp, Artificial Sequence
  Corresponding array ID: delta_3_22
ctgtgctggttacacccgaaggcaa

SEQ ID NO: 2153 - DNA, 25 bp, Artificial Sequence
  Corresponding array ID: delta_3_23
tcgccactttactctcccgacgaat

SEQ ID NO: 2154 - DNA, 25 bp, Artificial Sequence
  Corresponding array ID: delta_3_24
cctgtgctggttacacccgaaggca

SEQ ID NO: 2155 - DNA, 25 bp, Artificial Sequence
  Corresponding array ID: delta_3_25
gcttactctcacgagttcgctaccc

SEQ ID NO: 2156 - DNA, 25 bp, Artificial Sequence
  Corresponding array ID: altero_1_1
cccacttgggccaatctaaaggcga

SEQ ID NO: 2157 - DNA, 25 bp, Artificial Sequence
  Corresponding array ID: altero_1_2
atcccacttgggccaatctaaaggc

SEQ ID NO: 2158 - DNA, 25 bp, Artificial Sequence
  Corresponding array ID: altero_1_3
tcccacttgggccaatctaaaggcg

SEQ ID NO: 2159 - DNA, 25 bp, Artificial Sequence
  Corresponding array ID: altero_1_4
ccacttgggccaatctaaaggcgag

SEQ ID NO: 2160 - DNA, 25 bp, Artificial Sequence
  Corresponding array ID: altero_1_5
cacttgggccaatctaaaggcgaga

SEQ ID NO: 2161 - DNA, 25 bp, Artificial Sequence
  Corresponding array ID: altero_1_6
acttgggccaatctaaaggcgagag

SEQ ID NO: 2162 - DNA, 25 bp, Artificial Sequence
  Corresponding array ID: altero_1_7
cttgggccaatctaaaggcgagagc

SEQ ID NO: 2163 - DNA, 25 bp, Artificial Sequence
  Corresponding array ID: altero_1_8
ctgtcagtaacgtcacagctagcag

SEQ ID NO: 2164 - DNA, 25 bp, Artificial Sequence
  Corresponding array ID: altero_1_9
acagaaccgaggttccgagcttcta

SEQ ID NO: 2165 - DNA, 25 bp, Artificial Sequence
  Corresponding array ID: altero_1_10
cagaaccgaggttccgagcttctag

SEQ ID NO: 2166 - DNA, 25 bp, Artificial Sequence
  Corresponding array ID: altero_1_11
agaaccgaggttccgagcttctagt

SEQ ID NO: 2167 - DNA, 25 bp, Artificial Sequence
  Corresponding array ID: altero_1_12
gaaaaacagaaccgaggttccgagc

SEQ ID NO: 2168 - DNA, 25 bp, Artificial Sequence
  Corresponding array ID: altero_1_13
gaaccgaggttccgagcttctagta

SEQ ID NO: 2169 - DNA, 25 bp, Artificial Sequence
  Corresponding array ID: altero_1_14
ccgaggttccgagcttctagtagac

SEQ ID NO: 2170 - DNA, 25 bp, Artificial Sequence
  Corresponding array ID: altero_1_15
cgaggttccgagcttctagtagaca

SEQ ID NO: 2171 - DNA, 25 bp, Artificial Sequence
  Corresponding array ID: altero_1_16
aaccgaggttccgagcttctagtag

SEQ ID NO: 2172 - DNA, 25 bp, Artificial Sequence
  Corresponding array ID: altero_1_17
accgaggttccgagcttctagtaga

SEQ ID NO: 2173 - DNA, 25 bp, Artificial Sequence
  Corresponding array ID: altero_1_18
aacagaaccgaggttccgagcttct

SEQ ID NO: 2174 - DNA, 25 bp, Artificial Sequence
  Corresponding array ID: altero_1_19
aaacagaaccgaggttccgagcttc

SEQ ID NO: 2175 - DNA, 25 bp, Artificial Sequence
  Corresponding array ID: altero_1_20
ccaactgttgtcccccacctcaagg

SEQ ID NO: 2176 - DNA, 25 bp, Artificial Sequence
  Corresponding array ID: altero_1_21
ccggactacgacgcactttaagtga

SEQ ID NO: 2177 - DNA, 25 bp, Artificial Sequence
  Corresponding array ID: altero_1_22
tgggccaatctaaaggcgagagccg

SEQ ID NO: 2178 - DNA, 25 bp, Artificial Sequence
  Corresponding array ID: altero_1_23
gggccaatctaaaggcgagagccga

SEQ ID NO: 2179 - DNA, 25 bp, Artificial Sequence
  Corresponding array ID: altero_1_24
ttgggccaatctaaaggcgagagcc

SEQ ID NO: 2180 - DNA, 25 bp, Artificial Sequence
  Corresponding array ID: altero_1_25
ggttccgagcttctagtagacatcg

SEQ ID NO: 2181 - DNA, 25 bp, Artificial Sequence
  Corresponding array ID: altero_2_1
tctcacttgggcctctctttgcgcc

SEQ ID NO: 2182 - DNA, 25 bp, Artificial Sequence
  Corresponding array ID: altero_2_2
cccctcgcaaaggcaagttcccaag

SEQ ID NO: 2183 - DNA, 25 bp, Artificial Sequence
  Corresponding array ID: altero_2_3
ccctcgcaaaggcaagttcccaagc

SEQ ID NO: 2184 - DNA, 25 bp, Artificial Sequence
  Corresponding array ID: altero_2_4
tcacttgggcctctctttgcgccgg

SEQ ID NO: 2185 - DNA, 25 bp, Artificial Sequence
  Corresponding array ID: altero_2_5
cttgggcctctctttgcgccggagc

SEQ ID NO: 2186 - DNA, 25 bp, Artificial Sequence
  Corresponding array ID: altero_2_6
cgacattctttaaggggtccgctcc

SEQ ID NO: 2187 - DNA, 25 bp, Artificial Sequence
  Corresponding array ID: altero_2_7
cacttgggcctctctttgcgccgga

SEQ ID NO: 2188 - DNA, 25 bp, Artificial Sequence
  Corresponding array ID: altero_2_8
ctcacttgggcctctctttgcgccg

SEQ ID NO: 2189 - DNA, 25 bp, Artificial Sequence
  Corresponding array ID: altero_2_9
acttgggcctctctttgcgccggag

SEQ ID NO: 2190 - DNA, 25 bp, Artificial Sequence
  Corresponding array ID: altero_2_10
ctacgacattctttaaggggtccgc

SEQ ID NO: 2191 - DNA, 25 bp, Artificial Sequence
  Corresponding array ID: altero_2_11
ccggactacgacattctttaagggg

SEQ ID NO: 2192 - DNA, 25 bp, Artificial Sequence
  Corresponding array ID: altero_2_12
atctcacttgggcctctctttgcgc

SEQ ID NO: 2193 - DNA, 25 bp, Artificial Sequence
  Corresponding array ID: altero_2_13
ccccctcgcaaaggcaagttcccaa

SEQ ID NO: 2194 - DNA, 25 bp, Artificial Sequence
  Corresponding array ID: altero_2_14
acattctttaaggggtccgctccac

SEQ ID NO: 2195 - DNA, 25 bp, Artificial Sequence
  Corresponding array ID: altero_2_15
ttgggcctctctttgcgccggagcc

SEQ ID NO: 2196 - DNA, 25 bp, Artificial Sequence
  Corresponding array ID: altero_2_16
tccccctcgcaaaggcaagttccca

SEQ ID NO: 2197 - DNA, 25 bp, Artificial Sequence
  Corresponding array ID: altero_2_17
cctcgcaaaggcaagttcccaagca

SEQ ID NO: 2198 - DNA, 25 bp, Artificial Sequence
  Corresponding array ID: altero_2_18
gggtccgctccacatcactgtctcg

SEQ ID NO: 2199 - DNA, 25 bp, Artificial Sequence
  Corresponding array ID: altero_2_19
acgacattctttaaggggtccgctc

SEQ ID NO: 2200 - DNA, 25 bp, Artificial Sequence
  Corresponding array ID: altero_2_20
cattctttaaggggtccgctccaca

SEQ ID NO: 2201 - DNA, 25 bp, Artificial Sequence
  Corresponding array ID: altero_2_21
gacattctttaaggggtccgctcca

SEQ ID NO: 2202 - DNA, 25 bp, Artificial Sequence
  Corresponding array ID: altero_2_22
aatctcacttgggcctctctttgcg

SEQ ID NO: 2203 - DNA, 25 bp, Artificial Sequence
  Corresponding array ID: altero_2_23
taaggggtccgctccacatcactgt

SEQ ID NO: 2204 - DNA, 25 bp, Artificial Sequence
  Corresponding array ID: altero_2_24
atccccctcgcaaaggcaagttccc

SEQ ID NO: 2205 - DNA, 25 bp, Artificial Sequence
  Corresponding array ID: altero_2_25
ggtccgctccacatcactgtctcgc

SEQ ID NO: 2206 - DNA, 25 bp, Artificial Sequence
  Corresponding array ID: colwel_1_1
tgcgccactcacggatcaagtccac

SEQ ID NO: 2207 - DNA, 25 bp, Artificial Sequence
  Corresponding array ID: colwel_1_2
ctgcgccactcacggatcaagtcca

SEQ ID NO: 2208 - DNA, 25 bp, Artificial Sequence
  Corresponding array ID: colwel_1_3
gctgcgccactcacggatcaagtcc

SEQ ID NO: 2209 - DNA, 25 bp, Artificial Sequence
  Corresponding array ID: colwel_1_4
tagctgcgccactcacggatcaagt

SEQ ID NO: 2210 - DNA, 25 bp, Artificial Sequence
  Corresponding array ID: colwel_1_5
gttagctgcgccactcacggatcaa

SEQ ID NO: 2211 - DNA, 25 bp, Artificial Sequence
  Corresponding array ID: colwel_1_6
cgttagctgcgccactcacggatca

SEQ ID NO: 2212 - DNA, 25 bp, Artificial Sequence
  Corresponding array ID: colwel_1_7
gtgcgttagctgcgccactcacgga

SEQ ID NO: 2213 - DNA, 25 bp, Artificial Sequence
  Corresponding array ID: colwel_1_8
tgcgttagctgcgccactcacggat

SEQ ID NO: 2214 - DNA, 25 bp, Artificial Sequence
  Corresponding array ID: colwel_1_9
ttagctgcgccactcacggatcaag

SEQ ID NO: 2215 - DNA, 25 bp, Artificial Sequence
  Corresponding array ID: colwel_1_10
gcgttagctgcgccactcacggatc

SEQ ID NO: 2216 - DNA, 25 bp, Artificial Sequence
  Corresponding array ID: colwel_1_11
agctgcgccactcacggatcaagtc

SEQ ID NO: 2217 - DNA, 25 bp, Artificial Sequence
  Corresponding array ID: colwel_1_12
gcggtattgctgccctctgtacctg

SEQ ID NO: 2218 - DNA, 25 bp, Artificial Sequence
  Corresponding array ID: colwel_1_13
cgcggtattgctgccctctgtacct

SEQ ID NO: 2219 - DNA, 25 bp, Artificial Sequence
  Corresponding array ID: colwel_1_14
ggatcaagtccacgaacggctagtt

SEQ ID NO: 2220 - DNA, 25 bp, Artificial Sequence
  Corresponding array ID: colwel_1_15
cggatcaagtccacgaacggctagt

SEQ ID NO: 2221 - DNA, 25 bp, Artificial Sequence
  Corresponding array ID: colwel_1_16
gcgccactcacggatcaagtccacg

SEQ ID NO: 2222 - DNA, 25 bp, Artificial Sequence
  Corresponding array ID: colwel_1_17
acggatcaagtccacgaacggctag

SEQ ID NO: 2223 - DNA, 25 bp, Artificial Sequence
  Corresponding array ID: colwel_1_18
cacggatcaagtccacgaacggcta

SEQ ID NO: 2224 - DNA, 25 bp, Artificial Sequence
  Corresponding array ID: colwel_1_19
cgccactcacggatcaagtccacga

SEQ ID NO: 2225 - DNA, 25 bp, Artificial Sequence
  Corresponding array ID: colwel_1_20
gccactcacggatcaagtccacgaa

SEQ ID NO: 2226 - DNA, 25 bp, Artificial Sequence
  Corresponding array ID: colwel_1_21
tcacggatcaagtccacgaacggct

SEQ ID NO: 2227 - DNA, 25 bp, Artificial Sequence
  Corresponding array ID: colwel_1_22
gatcaagtccacgaacggctagttg

SEQ ID NO: 2228 - DNA, 25 bp, Artificial Sequence
  Corresponding array ID: colwel_1_23
actcacggatcaagtccacgaacgg

SEQ ID NO: 2229 - DNA, 25 bp, Artificial Sequence
  Corresponding array ID: colwel_1_24
cactcacggatcaagtccacgaacg

SEQ ID NO: 2230 - DNA, 25 bp, Artificial Sequence
  Corresponding array ID: colwel_1_25
ctcacggatcaagtccacgaacggc

SEQ ID NO: 2231 - DNA, 25 bp, Artificial Sequence
  Corresponding array ID: altero_3_1
caactgttgtcccccacgttttggc

SEQ ID NO: 2232 - DNA, 25 bp, Artificial Sequence
  Corresponding array ID: altero_3_2
aactgttgtcccccacgttttggca

SEQ ID NO: 2233 - DNA, 25 bp, Artificial Sequence
  Corresponding array ID: altero_3_3
ccccacgttttggcatattcccaag

SEQ ID NO: 2234 - DNA, 25 bp, Artificial Sequence
  Corresponding array ID: altero_3_4
cccacgttttggcatattcccaagc

SEQ ID NO: 2235 - DNA, 25 bp, Artificial Sequence
  Corresponding array ID: altero_3_5
tcccccacgttttggcatattccca

SEQ ID NO: 2236 - DNA, 25 bp, Artificial Sequence
  Corresponding array ID: altero_3_6
cccccacgttttggcatattcccaa

SEQ ID NO: 2237 - DNA, 25 bp, Artificial Sequence
  Corresponding array ID: altero_3_7
ccaactgttgtcccccacgttttgg

SEQ ID NO: 2238 - DNA, 25 bp, Artificial Sequence
  Corresponding array ID: altero_3_8
gtcccccacgttttggcatattccc

SEQ ID NO: 2239 - DNA, 25 bp, Artificial Sequence
  Corresponding array ID: altero_3_9
actgttgtcccccacgttttggcat

SEQ ID NO: 2240 - DNA, 25 bp, Artificial Sequence
  Corresponding array ID: altero_3_10
tccaactgttgtcccccacgttttg

SEQ ID NO: 2241 - DNA, 25 bp, Artificial Sequence
  Corresponding array ID: altero_3_11
tgtcccccacgttttggcatattcc

SEQ ID NO: 2242 - DNA, 25 bp, Artificial Sequence
  Corresponding array ID: altero_3_12
gcataccatcgctggttagcaaccc

SEQ ID NO: 2243 - DNA, 25 bp, Artificial Sequence
  Corresponding array ID: altero_3_13
cgcataccatcgctggttagcaacc

SEQ ID NO: 2244 - DNA, 25 bp, Artificial Sequence
  Corresponding array ID: altero_3_14
tcgcataccatcgctggttagcaac

SEQ ID NO: 2245 - DNA, 25 bp, Artificial Sequence
  Corresponding array ID: altero_3_15
ctgttgtcccccacgttttggcata

SEQ ID NO: 2246 - DNA, 25 bp, Artificial Sequence
  Corresponding array ID: altero_3_16
cttgggctaatcaaaacgcgcaagg

SEQ ID NO: 2247 - DNA, 25 bp, Artificial Sequence
  Corresponding array ID: altero_3_17
tcccacttgggctaatcaaaacgcg

SEQ ID NO: 2248 - DNA, 25 bp, Artificial Sequence
  Corresponding array ID: altero_3_18
ttgggctaatcaaaacgcgcaaggc

SEQ ID NO: 2249 - DNA, 25 bp, Artificial Sequence
  Corresponding array ID: altero_3_19
cccacttgggctaatcaaaacgcgc

SEQ ID NO: 2250 - DNA, 25 bp, Artificial Sequence
  Corresponding array ID: altero_3_20
tcaccggcagtctccctatagttcc

SEQ ID NO: 2251 - DNA, 25 bp, Artificial Sequence
  Corresponding array ID: altero_3_21
tgggctaatcaaaacgcgcaaggcc

SEQ ID NO: 2252 - DNA, 25 bp, Artificial Sequence
  Corresponding array ID: altero_3_22
ccacttgggctaatcaaaacgcgca

SEQ ID NO: 2253 - DNA, 25 bp, Artificial Sequence
  Corresponding array ID: altero_3_23
atagttcccgacataactcgctggc

SEQ ID NO: 2254 - DNA, 25 bp, Artificial Sequence
  Corresponding array ID: altero_3_24
ccatcgctggttagcaaccctttgt

SEQ ID NO: 2255 - DNA, 25 bp, Artificial Sequence
  Corresponding array ID: altero_3_25
gggctaatcaaaacgcgcaaggccc

SEQ ID NO: 2256 - DNA, 25 bp, Artificial Sequence
  Corresponding array ID: gamma_1_1
ctaaaaggtcaagcctcccaacggc

SEQ ID NO: 2257 - DNA, 25 bp, Artificial Sequence
  Corresponding array ID: gamma_1_2
actaaaaggtcaagcctcccaacgg

SEQ ID NO: 2258 - DNA, 25 bp, Artificial Sequence
  Corresponding array ID: gamma_1_3
gaagaggccctctttccctcttaag

SEQ ID NO: 2259 - DNA, 25 bp, Artificial Sequence
  Corresponding array ID: gamma_1_4
cactaaaaggtcaagcctcccaacg

SEQ ID NO: 2260 - DNA, 25 bp, Artificial Sequence
  Corresponding array ID: gamma_1_5
gcatgtattaggcctgccgccaacg

SEQ ID NO: 2261 - DNA, 25 bp, Artificial Sequence
  Corresponding array ID: gamma_1_6
ggctcctccaatagtgagagctttc

SEQ ID NO: 2262 - DNA, 25 bp, Artificial Sequence
  Corresponding array ID: gamma_1_7
aagaggccctctttccctcttaagg

SEQ ID NO: 2263 - DNA, 25 bp, Artificial Sequence
  Corresponding array ID: gamma_1_8
caagaagaggccctctttccctctt

SEQ ID NO: 2264 - DNA, 25 bp, Artificial Sequence
  Corresponding array ID: gamma_1_9
tcaagaagaggccctctttccctct

SEQ ID NO: 2265 - DNA, 25 bp, Artificial Sequence
  Corresponding array ID: gamma_1_10
tagctgcgccactaaaaggtcaagc

SEQ ID NO: 2266 - DNA, 25 bp, Artificial Sequence
  Corresponding array ID: gamma_1_11
caggctcctccaatagtgagagctt

SEQ ID NO: 2267 - DNA, 25 bp, Artificial Sequence
  Corresponding array ID: gamma_1_12
ctcagcgtcagtatcaatccagggg

SEQ ID NO: 2268 - DNA, 25 bp, Artificial Sequence
  Corresponding array ID: gamma_1_13
aaaggtcaagcctcccaacggctag

SEQ ID NO: 2269 - DNA, 25 bp, Artificial Sequence
  Corresponding array ID: gamma_1_14
gcgttagctgcgccactaaaaggtc

SEQ ID NO: 2270 - DNA, 25 bp, Artificial Sequence
  Corresponding array ID: gamma_1_15
gaggccctctttccctcttaaggcg

SEQ ID NO: 2271 - DNA, 25 bp, Artificial Sequence
  Corresponding array ID: gamma_1_16
agaggccctctttccctcttaaggc

SEQ ID NO: 2272 - DNA, 25 bp, Artificial Sequence
  Corresponding array ID: gamma_1_17
ccccctctatcgtactctagcctat

SEQ ID NO: 2273 - DNA, 25 bp, Artificial Sequence
  Corresponding array ID: gamma_1_18
cccctctatcgtactctagcctatc

SEQ ID NO: 2274 - DNA, 25 bp, Artificial Sequence
  Corresponding array ID: gamma_1_19
ttcaagaagaggccctctttccctc

SEQ ID NO: 2275 - DNA, 25 bp, Artificial Sequence
  Corresponding array ID: gamma_1_20
aggccctctttccctcttaaggcgt

SEQ ID NO: 2276 - DNA, 25 bp, Artificial Sequence
  Corresponding array ID: gamma_1_21
gccctctttccctcttaaggcgtat

SEQ ID NO: 2277 - DNA, 25 bp, Artificial Sequence
  Corresponding array ID: gamma_1_22
ccctctttccctcttaaggcgtatg

SEQ ID NO: 2278 - DNA, 25 bp, Artificial Sequence
  Corresponding array ID: gamma_1_23
ctctttccctcttaaggcgtatgcg

SEQ ID NO: 2279 - DNA, 25 bp, Artificial Sequence
  Corresponding array ID: gamma_1_24
cctctttccctcttaaggcgtatgc

SEQ ID NO: 2280 - DNA, 25 bp, Artificial Sequence
  Corresponding array ID: gamma_1_25
ggccctctttccctcttaaggcgta

SEQ ID NO: 2281 - DNA, 25 bp, Artificial Sequence
  Corresponding array ID: gamma_2_1
tacctgctagcaaccagggataggg

SEQ ID NO: 2282 - DNA, 25 bp, Artificial Sequence
  Corresponding array ID: gamma_2_2
cagcattacctgctagcaaccaggg

SEQ ID NO: 2283 - DNA, 25 bp, Artificial Sequence
  Corresponding array ID: gamma_2_3
ttacctgctagcaaccagggatagg

SEQ ID NO: 2284 - DNA, 25 bp, Artificial Sequence
  Corresponding array ID: gamma_2_4
acctgctagcaaccagggatagggg

SEQ ID NO: 2285 - DNA, 25 bp, Artificial Sequence
  Corresponding array ID: gamma_2_5
tcagcattacctgctagcaaccagg

SEQ ID NO: 2286 - DNA, 25 bp, Artificial Sequence
  Corresponding array ID: gamma_2_6
tctccctggagttctcagcattacc

SEQ ID NO: 2287 - DNA, 25 bp, Artificial Sequence
  Corresponding array ID: gamma_2_7
gtctccctggagttctcagcattac

SEQ ID NO: 2288 - DNA, 25 bp, Artificial Sequence
  Corresponding array ID: gamma_2_8
cagtctccctggagttctcagcatt

SEQ ID NO: 2289 - DNA, 25 bp, Artificial Sequence
  Corresponding array ID: gamma_2_9
tccctggagttctcagcattacctg

SEQ ID NO: 2290 - DNA, 25 bp, Artificial Sequence
  Corresponding array ID: gamma_2_10
ctccctggagttctcagcattacct

SEQ ID NO: 2291 - DNA, 25 bp, Artificial Sequence
  Corresponding array ID: gamma_2_11
gcagtctccctggagttctcagcat

SEQ ID NO: 2292 - DNA, 25 bp, Artificial Sequence
  Corresponding array ID: gamma_2_12
ggcagtctccctggagttctcagca

SEQ ID NO: 2293 - DNA, 25 bp, Artificial Sequence
  Corresponding array ID: gamma_2_13
cctgctagcaaccagggataggggt

SEQ ID NO: 2294 - DNA, 25 bp, Artificial Sequence
  Corresponding array ID: gamma_2_14
tgctagcaaccagggataggggttg

SEQ ID NO: 2295 - DNA, 25 bp, Artificial Sequence
  Corresponding array ID: gamma_2_15
ctgctagcaaccagggataggggtt

SEQ ID NO: 2296 - DNA, 25 bp, Artificial Sequence
  Corresponding array ID: gamma_2_16
tagcaaccagggataggggttgcgc

SEQ ID NO: 2297 - DNA, 25 bp, Artificial Sequence
  Corresponding array ID: gamma_2_17
agcaaccagggataggggttgcgct

SEQ ID NO: 2298 - DNA, 25 bp, Artificial Sequence
  Corresponding array ID: gamma_2_18
ctcagcattacctgctagcaaccag

SEQ ID NO: 2299 - DNA, 25 bp, Artificial Sequence
  Corresponding array ID: gamma_2_19
ctagcaaccagggataggggttgcg

SEQ ID NO: 2300 - DNA, 25 bp, Artificial Sequence
  Corresponding array ID: gamma_2_20
gctagcaaccagggataggggttgc

SEQ ID NO: 2301 - DNA, 25 bp, Artificial Sequence
  Corresponding array ID: gamma_2_21
gcattacctgctagcaaccagggat

SEQ ID NO: 2302 - DNA, 25 bp, Artificial Sequence
  Corresponding array ID: gamma_2_22
agcattacctgctagcaaccaggga

SEQ ID NO: 2303 - DNA, 25 bp, Artificial Sequence
  Corresponding array ID: gamma_2_23
tcgcgagttggcagccctctgtacg

SEQ ID NO: 2304 - DNA, 25 bp, Artificial Sequence
  Corresponding array ID: gamma_2_24
ctcgcgagttggcagccctctgtac

SEQ ID NO: 2305 - DNA, 25 bp, Artificial Sequence
  Corresponding array ID: gamma_2_25
cgcgagttggcagccctctgtacgc

SEQ ID NO: 2306 - DNA, 25 bp, Artificial Sequence
  Corresponding array ID: gamma_3_1
tgcgacaccgaagggcaaccccccc

SEQ ID NO: 2307 - DNA, 25 bp, Artificial Sequence
  Corresponding array ID: gamma_3_2
ctgcgacaccgaagggcaacccccc

SEQ ID NO: 2308 - DNA, 25 bp, Artificial Sequence
  Corresponding array ID: gamma_3_3
gactagttccgagtatgtcaagggc

SEQ ID NO: 2309 - DNA, 25 bp, Artificial Sequence
  Corresponding array ID: gamma_3_4
gctgcgacaccgaagggcaaccccc

SEQ ID NO: 2310 - DNA, 25 bp, Artificial Sequence
  Corresponding array ID: gamma_3_5
aacgcgctagctgcgacaccgaagg

SEQ ID NO: 2311 - DNA, 25 bp, Artificial Sequence
  Corresponding array ID: gamma_3_6
taacgcgctagctgcgacaccgaag

SEQ ID NO: 2312 - DNA, 25 bp, Artificial Sequence
  Corresponding array ID: gamma_3_7
ttacttaaccgccaacgcgcgcttt

SEQ ID NO: 2313 - DNA, 25 bp, Artificial Sequence
  Corresponding array ID: gamma_3_8
acgcgctagctgcgacaccgaaggg

SEQ ID NO: 2314 - DNA, 25 bp, Artificial Sequence
  Corresponding array ID: gamma_3_9
ttaacgcgctagctgcgacaccgaa

SEQ ID NO: 2315 - DNA, 25 bp, Artificial Sequence
  Corresponding array ID: gamma_3_10
cgcgctagctgcgacaccgaagggc

SEQ ID NO: 2316 - DNA, 25 bp, Artificial Sequence
  Corresponding array ID: gamma_3_11
tacttaaccgccaacgcgcgcttta

SEQ ID NO: 2317 - DNA, 25 bp, Artificial Sequence
  Corresponding array ID: gamma_3_12
agctgcgacaccgaagggcaacccc

SEQ ID NO: 2318 - DNA, 25 bp, Artificial Sequence
  Corresponding array ID: gamma_3_13
cttacttaaccgccaacgcgcgctt

SEQ ID NO: 2319 - DNA, 25 bp, Artificial Sequence
  Corresponding array ID: gamma_3_14
atccgacttacttaaccgccaacgc

SEQ ID NO: 2320 - DNA, 25 bp, Artificial Sequence
  Corresponding array ID: gamma_3_15
cgacttacttaaccgccaacgcgcg

SEQ ID NO: 2321 - DNA, 25 bp, Artificial Sequence
  Corresponding array ID: gamma_3_16
tccgacttacttaaccgccaacgcg

SEQ ID NO: 2322 - DNA, 25 bp, Artificial Sequence
  Corresponding array ID: gamma_3_17
cttaacgcgctagctgcgacaccga

SEQ ID NO: 2323 - DNA, 25 bp, Artificial Sequence
  Corresponding array ID: gamma_3_18
acttacttaaccgccaacgcgcgct

SEQ ID NO: 2324 - DNA, 25 bp, Artificial Sequence
  Corresponding array ID: gamma_3_19
gcgctagctgcgacaccgaagggca

SEQ ID NO: 2325 - DNA, 25 bp, Artificial Sequence
  Corresponding array ID: gamma_3_20
ccgacttacttaaccgccaacgcgc

SEQ ID NO: 2326 - DNA, 25 bp, Artificial Sequence
  Corresponding array ID: gamma_3_21
acttaaccgccaacgcgcgctttac

SEQ ID NO: 2327 - DNA, 25 bp, Artificial Sequence
  Corresponding array ID: gamma_3_22
catccgacttacttaaccgccaacg

SEQ ID NO: 2328 - DNA, 25 bp, Artificial Sequence
  Corresponding array ID: gamma_3_23
tcttcacacacgcggcattgctaga

SEQ ID NO: 2329 - DNA, 25 bp, Artificial Sequence
  Corresponding array ID: gamma_3_24
agaacttaacgcgctagctgcgaca

SEQ ID NO: 2330 - DNA, 25 bp, Artificial Sequence
  Corresponding array ID: gamma_3_25
acttaacgcgctagctgcgacaccg

SEQ ID NO: 2331 - DNA, 25 bp, Artificial Sequence
  Corresponding array ID: gamma_4_1
acaccgaaaggcaaaccctcccgac

SEQ ID NO: 2332 - DNA, 25 bp, Artificial Sequence
  Corresponding array ID: gamma_4_2
gacaccgaaaggcaaaccctcccga

SEQ ID NO: 2333 - DNA, 25 bp, Artificial Sequence
  Corresponding array ID: gamma_4_3
caccgaaaggcaaaccctcccgaca

SEQ ID NO: 2334 - DNA, 25 bp, Artificial Sequence
  Corresponding array ID: gamma_4_4
accgaaaggcaaaccctcccgacat

SEQ ID NO: 2335 - DNA, 25 bp, Artificial Sequence
  Corresponding array ID: gamma_4_5
cgacaccgaaaggcaaaccctcccg

SEQ ID NO: 2336 - DNA, 25 bp, Artificial Sequence
  Corresponding array ID: gamma_4_6
ccgaaaggcaaaccctcccgacatc

SEQ ID NO: 2337 - DNA, 25 bp, Artificial Sequence
  Corresponding array ID: gamma_4_7
gcgacaccgaaaggcaaaccctccc

SEQ ID NO: 2338 - DNA, 25 bp, Artificial Sequence
  Corresponding array ID: gamma_4_8
cgaaaggcaaaccctcccgacatct

SEQ ID NO: 2339 - DNA, 25 bp, Artificial Sequence
  Corresponding array ID: gamma_4_9
gctgcgacaccgaaaggcaaaccct

SEQ ID NO: 2340 - DNA, 25 bp, Artificial Sequence
  Corresponding array ID: gamma_4_10
agctgcgacaccgaaaggcaaaccc

SEQ ID NO: 2341 - DNA, 25 bp, Artificial Sequence
  Corresponding array ID: gamma_4_11
ttggctagccattgctggtttgcag

SEQ ID NO: 2342 - DNA, 25 bp, Artificial Sequence
  Corresponding array ID: gamma_4_12
tggctagccattgctggtttgcagc

SEQ ID NO: 2343 - DNA, 25 bp, Artificial Sequence
  Corresponding array ID: gamma_4_13
ggattggctagccattgctggtttg

SEQ ID NO: 2344 - DNA, 25 bp, Artificial Sequence
  Corresponding array ID: gamma_4_14
gattggctagccattgctggtttgc

SEQ ID NO: 2345 - DNA, 25 bp, Artificial Sequence
  Corresponding array ID: gamma_4_15
gggattggctagccattgctggttt

SEQ ID NO: 2346 - DNA, 25 bp, Artificial Sequence
  Corresponding array ID: gamma_4_16
ggctagccattgctggtttgcagcc

SEQ ID NO: 2347 - DNA, 25 bp, Artificial Sequence
  Corresponding array ID: gamma_4_17
gaaaggcaaaccctcccgacatcta

SEQ ID NO: 2348 - DNA, 25 bp, Artificial Sequence
  Corresponding array ID: gamma_4_18
ctgcgacaccgaaaggcaaaccctc

SEQ ID NO: 2349 - DNA, 25 bp, Artificial Sequence
  Corresponding array ID: gamma_4_19
tgcgacaccgaaaggcaaaccctcc

SEQ ID NO: 2350 - DNA, 25 bp, Artificial Sequence
  Corresponding array ID: gamma_4_20
agggattggctagccattgctggtt

SEQ ID NO: 2351 - DNA, 25 bp, Artificial Sequence
  Corresponding array ID: gamma_4_21
aagggattggctagccattgctggt

SEQ ID NO: 2352 - DNA, 25 bp, Artificial Sequence
  Corresponding array ID: gamma_4_22
taagggattggctagccattgctgg

SEQ ID NO: 2353 - DNA, 25 bp, Artificial Sequence
  Corresponding array ID: gamma_4_23
tagctgcgacaccgaaaggcaaacc

SEQ ID NO: 2354 - DNA, 25 bp, Artificial Sequence
  Corresponding array ID: gamma_4_24
ttagctgcgacaccgaaaggcaaac

SEQ ID NO: 2355 - DNA, 25 bp, Artificial Sequence
  Corresponding array ID: gamma_4_25
gttagctgcgacaccgaaaggcaaa

SEQ ID NO: 2356 - DNA, 25 bp, Artificial Sequence
  Corresponding array ID: gamma_5_1
ccactaagggacaaattcccccaac

SEQ ID NO: 2357 - DNA, 25 bp, Artificial Sequence
  Corresponding array ID: gamma_5_2
cgccactaagggacaaattccccca

SEQ ID NO: 2358 - DNA, 25 bp, Artificial Sequence
  Corresponding array ID: gamma_5_3
gccactaagggacaaattcccccaa

SEQ ID NO: 2359 - DNA, 25 bp, Artificial Sequence
  Corresponding array ID: gamma_5_4
cactaagggacaaattcccccaacg

SEQ ID NO: 2360 - DNA, 25 bp, Artificial Sequence
  Corresponding array ID: gamma_5_5
actaagggacaaattcccccaacgg

SEQ ID NO: 2361 - DNA, 25 bp, Artificial Sequence
  Corresponding array ID: gamma_5_6
ctaagggacaaattcccccaacggc

SEQ ID NO: 2362 - DNA, 25 bp, Artificial Sequence
  Corresponding array ID: gamma_5_7
gcgccactaagggacaaattccccc

SEQ ID NO: 2363 - DNA, 25 bp, Artificial Sequence
  Corresponding array ID: gamma_5_8
ggtaccgtcaagacgcgcagttatt

SEQ ID NO: 2364 - DNA, 25 bp, Artificial Sequence
  Corresponding array ID: gamma_5_9
aggtaccgtcaagacgcgcagttat

SEQ ID NO: 2365 - DNA, 25 bp, Artificial Sequence
  Corresponding array ID: gamma_5_10
taggtaccgtcaagacgcgcagtta

SEQ ID NO: 2366 - DNA, 25 bp, Artificial Sequence
  Corresponding array ID: gamma_5_11
tgcgccactaagggacaaattcccc

SEQ ID NO: 2367 - DNA, 25 bp, Artificial Sequence
  Corresponding array ID: gamma_5_12
taagggacaaattcccccaacggct

SEQ ID NO: 2368 - DNA, 25 bp, Artificial Sequence
  Corresponding array ID: gamma_5_13
ctgtaggtaccgtcaagacgcgcag

SEQ ID NO: 2369 - DNA, 25 bp, Artificial Sequence
  Corresponding array ID: gamma_5_14
gtaggtaccgtcaagacgcgcagtt

SEQ ID NO: 2370 - DNA, 25 bp, Artificial Sequence
  Corresponding array ID: gamma_5_15
ctgcgccactaagggacaaattccc

SEQ ID NO: 2371 - DNA, 25 bp, Artificial Sequence
  Corresponding array ID: gamma_5_16
tgtaggtaccgtcaagacgcgcagt

SEQ ID NO: 2372 - DNA, 25 bp, Artificial Sequence
  Corresponding array ID: gamma_5_17
tctgtaggtaccgtcaagacgcgca

SEQ ID NO: 2373 - DNA, 25 bp, Artificial Sequence
  Corresponding array ID: gamma_5_18
gtccgccactcgacgcctgaagagc

SEQ ID NO: 2374 - DNA, 25 bp, Artificial Sequence
  Corresponding array ID: gamma_5_19
gccactcgacgcctgaagagcaagc

SEQ ID NO: 2375 - DNA, 25 bp, Artificial Sequence
  Corresponding array ID: gamma_5_20
gctgcgccactaagggacaaattcc

SEQ ID NO: 2376 - DNA, 25 bp, Artificial Sequence
  Corresponding array ID: gamma_5_21
cactcggttcccgaaggcaccaaac

SEQ ID NO: 2377 - DNA, 25 bp, Artificial Sequence
  Corresponding array ID: gamma_5_22
cttctgtaggtaccgtcaagacgcg

SEQ ID NO: 2378 - DNA, 25 bp, Artificial Sequence
  Corresponding array ID: gamma_5_23
cactcgacgcctgaagagcaagctc

SEQ ID NO: 2379 - DNA, 25 bp, Artificial Sequence
  Corresponding array ID: gamma_5_24
cgccactcgacgcctgaagagcaag

SEQ ID NO: 2380 - DNA, 25 bp, Artificial Sequence
  Corresponding array ID: gamma_5_25
ggacaaattcccccaacggctagtt

SEQ ID NO: 2381 - DNA, 25 bp, Artificial Sequence
  Corresponding array ID: gamma_6_1
agctgcgccaccaacctcttgaatg

SEQ ID NO: 2382 - DNA, 25 bp, Artificial Sequence
  Corresponding array ID: gamma_6_2
ccaacctcttgaatgaggccgacgg

SEQ ID NO: 2383 - DNA, 25 bp, Artificial Sequence
  Corresponding array ID: gamma_6_3
tgcgccaccaacctcttgaatgagg

SEQ ID NO: 2384 - DNA, 25 bp, Artificial Sequence
  Corresponding array ID: gamma_6_4
gccaccaacctcttgaatgaggccg

SEQ ID NO: 2385 - DNA, 25 bp, Artificial Sequence
  Corresponding array ID: gamma_6_5
accaacctcttgaatgaggccgacg

SEQ ID NO: 2386 - DNA, 25 bp, Artificial Sequence
  Corresponding array ID: gamma_6_6
ctgcgccaccaacctcttgaatgag

SEQ ID NO: 2387 - DNA, 25 bp, Artificial Sequence
  Corresponding array ID: gamma_6_7
caacctcttgaatgaggccgacggc

SEQ ID NO: 2388 - DNA, 25 bp, Artificial Sequence
  Corresponding array ID: gamma_6_8
gcgccaccaacctcttgaatgaggc

SEQ ID NO: 2389 - DNA, 25 bp, Artificial Sequence
  Corresponding array ID: gamma_6_9
cgccaccaacctcttgaatgaggcc

SEQ ID NO: 2390 - DNA, 25 bp, Artificial Sequence
  Corresponding array ID: gamma_6_10
caccaacctcttgaatgaggccgac

SEQ ID NO: 2391 - DNA, 25 bp, Artificial Sequence
  Corresponding array ID: gamma_6_11
gctgcgccaccaacctcttgaatga

SEQ ID NO: 2392 - DNA, 25 bp, Artificial Sequence
  Corresponding array ID: gamma_6_12
ccaccaacctcttgaatgaggccga

SEQ ID NO: 2393 - DNA, 25 bp, Artificial Sequence
  Corresponding array ID: gamma_6_13
tagctgcgccaccaacctcttgaat

SEQ ID NO: 2394 - DNA, 25 bp, Artificial Sequence
  Corresponding array ID: gamma_6_14
aacctcttgaatgaggccgacggct

SEQ ID NO: 2395 - DNA, 25 bp, Artificial Sequence
  Corresponding array ID: gamma_6_15
agaggtccactttgccccgaagggc

SEQ ID NO: 2396 - DNA, 25 bp, Artificial Sequence
  Corresponding array ID: gamma_6_16
gaggtccactttgccccgaagggcg

SEQ ID NO: 2397 - DNA, 25 bp, Artificial Sequence
  Corresponding array ID: gamma_6_17
tcttcaggtaacgtcaatacgcgcg

SEQ ID NO: 2398 - DNA, 25 bp, Artificial Sequence
  Corresponding array ID: gamma_6_18
ttagctgcgccaccaacctcttgaa

SEQ ID NO: 2399 - DNA, 25 bp, Artificial Sequence
  Corresponding array ID: gamma_6_19
cagaggtccactttgccccgaaggg

SEQ ID NO: 2400 - DNA, 25 bp, Artificial Sequence
  Corresponding array ID: gamma_6_20
aggtccactttgccccgaagggcgt

SEQ ID NO: 2401 - DNA, 25 bp, Artificial Sequence
  Corresponding array ID: gamma_6_21
acctcttgaatgaggccgacggcta

SEQ ID NO: 2402 - DNA, 25 bp, Artificial Sequence
  Corresponding array ID: gamma_6_22
cgcgcgggtattaaccgcacgcttt

SEQ ID NO: 2403 - DNA, 25 bp, Artificial Sequence
  Corresponding array ID: gamma_6_23
cttcaggtaacgtcaatacgcgcgg

SEQ ID NO: 2404 - DNA, 25 bp, Artificial Sequence
  Corresponding array ID: gamma_6_24
tcagaggtccactttgccccgaagg

SEQ ID NO: 2405 - DNA, 25 bp, Artificial Sequence
  Corresponding array ID: gamma_6_25
acgcgcgggtattaaccgcacgctt

SEQ ID NO: 2406 - DNA, 25 bp, Artificial Sequence
  Corresponding array ID: gamma_7_1
gtcctccgtagttagactagccact

SEQ ID NO: 2407 - DNA, 25 bp, Artificial Sequence
  Corresponding array ID: gamma_7_2
cgtcctccgtagttagactagccac

SEQ ID NO: 2408 - DNA, 25 bp, Artificial Sequence
  Corresponding array ID: gamma_7_3
accgtcctccgtagttagactagcc

SEQ ID NO: 2409 - DNA, 25 bp, Artificial Sequence
  Corresponding array ID: gamma_7_4
ccgtcctccgtagttagactagcca

SEQ ID NO: 2410 - DNA, 25 bp, Artificial Sequence
  Corresponding array ID: gamma_7_5
gaccgtcctccgtagttagactagc

SEQ ID NO: 2411 - DNA, 25 bp, Artificial Sequence
  Corresponding array ID: gamma_7_6
tgaccgtcctccgtagttagactag

SEQ ID NO: 2412 - DNA, 25 bp, Artificial Sequence
  Corresponding array ID: gamma_7_7
ctgcaggtaacgtcaagtactcacc

SEQ ID NO: 2413 - DNA, 25 bp, Artificial Sequence
  Corresponding array ID: gamma_7_8
tattaggggtaagccttcctccctg

SEQ ID NO: 2414 - DNA, 25 bp, Artificial Sequence
  Corresponding array ID: gamma_7_9
tgcaggtaacgtcaagtactcaccc

SEQ ID NO: 2415 - DNA, 25 bp, Artificial Sequence
  Corresponding array ID: gamma_7_10
gcaggtaacgtcaagtactcacccg

SEQ ID NO: 2416 - DNA, 25 bp, Artificial Sequence
  Corresponding array ID: gamma_7_11
ttccccgggttgtcccccactcatg

SEQ ID NO: 2417 - DNA, 25 bp, Artificial Sequence
  Corresponding array ID: gamma_7_12
tccccgggttgtcccccactcatgg

SEQ ID NO: 2418 - DNA, 25 bp, Artificial Sequence
  Corresponding array ID: gamma_7_13
ccccgggttgtcccccactcatggg

SEQ ID NO: 2419 - DNA, 25 bp, Artificial Sequence
  Corresponding array ID: gamma_7_14
tttccccgggttgtcccccactcat

SEQ ID NO: 2420 - DNA, 25 bp, Artificial Sequence
  Corresponding array ID: gamma_7_15
cccgggttgtcccccactcatgggt

SEQ ID NO: 2421 - DNA, 25 bp, Artificial Sequence
  Corresponding array ID: gamma_7_16
ccgggttgtcccccactcatgggta

SEQ ID NO: 2422 - DNA, 25 bp, Artificial Sequence
  Corresponding array ID: gamma_7_17
ctcacccgtattaggggtaagcctt

SEQ ID NO: 2423 - DNA, 25 bp, Artificial Sequence
  Corresponding array ID: gamma_7_18
acccgtattaggggtaagccttcct

SEQ ID NO: 2424 - DNA, 25 bp, Artificial Sequence
  Corresponding array ID: gamma_7_19
actcacccgtattaggggtaagcct

SEQ ID NO: 2425 - DNA, 25 bp, Artificial Sequence
  Corresponding array ID: gamma_7_20
gtcaagtactcacccgtattagggg

SEQ ID NO: 2426 - DNA, 25 bp, Artificial Sequence
  Corresponding array ID: gamma_7_21
tcacccgtattaggggtaagccttc

SEQ ID NO: 2427 - DNA, 25 bp, Artificial Sequence
  Corresponding array ID: gamma_7_22
cccgtattaggggtaagccttcctc

SEQ ID NO: 2428 - DNA, 25 bp, Artificial Sequence
  Corresponding array ID: gamma_7_23
gtactcacccgtattaggggtaagc

SEQ ID NO: 2429 - DNA, 25 bp, Artificial Sequence
  Corresponding array ID: gamma_7_24
cacccgtattaggggtaagccttcc

SEQ ID NO: 2430 - DNA, 25 bp, Artificial Sequence
  Corresponding array ID: gamma_7_25
tactcacccgtattaggggtaagcc

SEQ ID NO: 2431 - DNA, 25 bp, Artificial Sequence
  Corresponding array ID: gamma_8_1
cgcgagctcatccatcagcacaagg

SEQ ID NO: 2432 - DNA, 25 bp, Artificial Sequence
  Corresponding array ID: gamma_8_2
tcatccatcagcacaaggtccgaag

SEQ ID NO: 2433 - DNA, 25 bp, Artificial Sequence
  Corresponding array ID: gamma_8_3
ctcatccatcagcacaaggtccgaa

SEQ ID NO: 2434 - DNA, 25 bp, Artificial Sequence
  Corresponding array ID: gamma_8_4
gctcatccatcagcacaaggtccga

SEQ ID NO: 2435 - DNA, 25 bp, Artificial Sequence
  Corresponding array ID: gamma_8_5
acgcgagctcatccatcagcacaag

SEQ ID NO: 2436 - DNA, 25 bp, Artificial Sequence
  Corresponding array ID: gamma_8_6
catccatcagcacaaggtccgaaga

SEQ ID NO: 2437 - DNA, 25 bp, Artificial Sequence
  Corresponding array ID: gamma_8_7
gacgcgagctcatccatcagcacaa

SEQ ID NO: 2438 - DNA, 25 bp, Artificial Sequence
  Corresponding array ID: gamma_8_8
gcgagctcatccatcagcacaaggt

SEQ ID NO: 2439 - DNA, 25 bp, Artificial Sequence
  Corresponding array ID: gamma_8_9
tccatcagcacaaggtccgaagatc

SEQ ID NO: 2440 - DNA, 25 bp, Artificial Sequence
  Corresponding array ID: gamma_8_10
cgacgcgagctcatccatcagcaca

SEQ ID NO: 2441 - DNA, 25 bp, Artificial Sequence
  Corresponding array ID: gamma_8_11
catcagcacaaggtccgaagatccc

SEQ ID NO: 2442 - DNA, 25 bp, Artificial Sequence
  Corresponding array ID: gamma_8_12
ccctctaatgggcagattctcacgt

SEQ ID NO: 2443 - DNA, 25 bp, Artificial Sequence
  Corresponding array ID: gamma_8_13
ccgacgcgagctcatccatcagcac

SEQ ID NO: 2444 - DNA, 25 bp, Artificial Sequence
  Corresponding array ID: gamma_8_14
cccctctaatgggcagattctcacg

SEQ ID NO: 2445 - DNA, 25 bp, Artificial Sequence
  Corresponding array ID: gamma_8_15
ccccctctaatgggcagattctcac

SEQ ID NO: 2446 - DNA, 25 bp, Artificial Sequence
  Corresponding array ID: gamma_8_16
cgagctcatccatcagcacaaggtc

SEQ ID NO: 2447 - DNA, 25 bp, Artificial Sequence
  Corresponding array ID: gamma_8_17
ccatcagcacaaggtccgaagatcc

SEQ ID NO: 2448 - DNA, 25 bp, Artificial Sequence
  Corresponding array ID: gamma_8_18
cctctaatgggcagattctcacgtg

SEQ ID NO: 2449 - DNA, 25 bp, Artificial Sequence
  Corresponding array ID: gamma_8_19
cccaggttatccccctctaatgggc

SEQ ID NO: 2450 - DNA, 25 bp, Artificial Sequence
  Corresponding array ID: gamma_8_20
tccgacgcgagctcatccatcagca

SEQ ID NO: 2451 - DNA, 25 bp, Artificial Sequence
  Corresponding array ID: gamma_8_21
gagctcatccatcagcacaaggtcc

SEQ ID NO: 2452 - DNA, 25 bp, Artificial Sequence
  Corresponding array ID: gamma_8_22
ttccccaggttatccccctctaatg

SEQ ID NO: 2453 - DNA, 25 bp, Artificial Sequence
  Corresponding array ID: gamma_8_23
tccccaggttatccccctctaatgg

SEQ ID NO: 2454 - DNA, 25 bp, Artificial Sequence
  Corresponding array ID: gamma_8_24
ccccaggttatccccctctaatggg

SEQ ID NO: 2455 - DNA, 25 bp, Artificial Sequence
  Corresponding array ID: gamma_8_25
atccccctctaatgggcagattctc

SEQ ID NO: 2456 - DNA, 25 bp, Artificial Sequence
  Corresponding array ID: gamma_9_1
cctgtccatcggttcccgaaggcac

SEQ ID NO: 2457 - DNA, 25 bp, Artificial Sequence
  Corresponding array ID: gamma_9_2
ctgtccatcggttcccgaaggcacc

SEQ ID NO: 2458 - DNA, 25 bp, Artificial Sequence
  Corresponding array ID: gamma_9_3
tgtccatcggttcccgaaggcacca

SEQ ID NO: 2459 - DNA, 25 bp, Artificial Sequence
  Corresponding array ID: gamma_9_4
cagcacctgtccatcggttcccgaa

SEQ ID NO: 2460 - DNA, 25 bp, Artificial Sequence
  Corresponding array ID: gamma_9_5
agcacctgtccatcggttcccgaag

SEQ ID NO: 2461 - DNA, 25 bp, Artificial Sequence
  Corresponding array ID: gamma_9_6
acctgtccatcggttcccgaaggca

SEQ ID NO: 2462 - DNA, 25 bp, Artificial Sequence
  Corresponding array ID: gamma_9_7
gtccatcggttcccgaaggcaccaa

SEQ ID NO: 2463 - DNA, 25 bp, Artificial Sequence
  Corresponding array ID: gamma_9_8
cacctgtccatcggttcccgaaggc

SEQ ID NO: 2464 - DNA, 25 bp, Artificial Sequence
  Corresponding array ID: gamma_9_9
cctccctctctcgcactctagcctt

SEQ ID NO: 2465 - DNA, 25 bp, Artificial Sequence
  Corresponding array ID: gamma_9_10
gcacctgtccatcggttcccgaagg

SEQ ID NO: 2466 - DNA, 25 bp, Artificial Sequence
  Corresponding array ID: gamma_9_11
gcagcacctgtccatcggttcccga

SEQ ID NO: 2467 - DNA, 25 bp, Artificial Sequence
  Corresponding array ID: gamma_9_12
acctccctctctcgcactctagcct

SEQ ID NO: 2468 - DNA, 25 bp, Artificial Sequence
  Corresponding array ID: gamma_9_13
ctccctctctcgcactctagccttc

SEQ ID NO: 2469 - DNA, 25 bp, Artificial Sequence
  Corresponding array ID: gamma_9_14
tctctcgcactctagccttccagta

SEQ ID NO: 2470 - DNA, 25 bp, Artificial Sequence
  Corresponding array ID: gamma_9_15
tcgcactctagccttccagtatcgg

SEQ ID NO: 2471 - DNA, 25 bp, Artificial Sequence
  Corresponding array ID: gamma_9_16
ctcgcactctagccttccagtatcg

SEQ ID NO: 2472 - DNA, 25 bp, Artificial Sequence
  Corresponding array ID: gamma_9_17
tacctccctctctcgcactctagcc

SEQ ID NO: 2473 - DNA, 25 bp, Artificial Sequence
  Corresponding array ID: gamma_9_18
ctctcgcactctagccttccagtat

SEQ ID NO: 2474 - DNA, 25 bp, Artificial Sequence
  Corresponding array ID: gamma_9_19
ccctctctcgcactctagccttcca

SEQ ID NO: 2475 - DNA, 25 bp, Artificial Sequence
  Corresponding array ID: gamma_9_20
tgcagcacctgtccatcggttcccg

SEQ ID NO: 2476 - DNA, 25 bp, Artificial Sequence
  Corresponding array ID: gamma_9_21
actccgtggtaatcgccctcccgaa

SEQ ID NO: 2477 - DNA, 25 bp, Artificial Sequence
  Corresponding array ID: gamma_9_22
tccatcggttcccgaaggcaccaat

SEQ ID NO: 2478 - DNA, 25 bp, Artificial Sequence
  Corresponding array ID: gamma_9_23
tcactccgtggtaatcgccctcccg

SEQ ID NO: 2479 - DNA, 25 bp, Artificial Sequence
  Corresponding array ID: gamma_9_24
tccctctctcgcactctagccttcc

SEQ ID NO: 2480 - DNA, 25 bp, Artificial Sequence
  Corresponding array ID: gamma_9_25
cctctctcgcactctagccttccag

SEQ ID NO: 2481 - DNA, 25 bp, Artificial Sequence
  Corresponding array ID: gamma_10_1
cgcaggcacatccgatagcgagagc

SEQ ID NO: 2482 - DNA, 25 bp, Artificial Sequence
  Corresponding array ID: gamma_10_2
acgcaggcacatccgatagcgagag

SEQ ID NO: 2483 - DNA, 25 bp, Artificial Sequence
  Corresponding array ID: gamma_10_3
gcggcttcgcggccctctgtacttg

SEQ ID NO: 2484 - DNA, 25 bp, Artificial Sequence
  Corresponding array ID: gamma_10_4
cggcttcgcggccctctgtacttgc

SEQ ID NO: 2485 - DNA, 25 bp, Artificial Sequence
  Corresponding array ID: gamma_10_5
ggcttcgcggccctctgtacttgcc

SEQ ID NO: 2486 - DNA, 25 bp, Artificial Sequence
  Corresponding array ID: gamma_10_6
cgcggcttcgcggccctctgtactt

SEQ ID NO: 2487 - DNA, 25 bp, Artificial Sequence
  Corresponding array ID: gamma_10_7
gcttcgcggccctctgtacttgcca

SEQ ID NO: 2488 - DNA, 25 bp, Artificial Sequence
  Corresponding array ID: gamma_10_8
cactactgggtagtttcctacgcgt

SEQ ID NO: 2489 - DNA, 25 bp, Artificial Sequence
  Corresponding array ID: gamma_10_9
ccactactgggtagtttcctacgcg

SEQ ID NO: 2490 - DNA, 25 bp, Artificial Sequence
  Corresponding array ID: gamma_10_10
ccccactactgggtagtttcctacg

SEQ ID NO: 2491 - DNA, 25 bp, Artificial Sequence
  Corresponding array ID: gamma_10_11
cccactactgggtagtttcctacgc

SEQ ID NO: 2492 - DNA, 25 bp, Artificial Sequence
  Corresponding array ID: gamma_10_12
cccccactactgggtagtttcctac

SEQ ID NO: 2493 - DNA, 25 bp, Artificial Sequence
  Corresponding array ID: gamma_10_13
actaccgggtagtttcctacgcgtt

SEQ ID NO: 2494 - DNA, 25 bp, Artificial Sequence
  Corresponding array ID: gamma_10_14
cactaccgggtagtttcctacgcgt

SEQ ID NO: 2495 - DNA, 25 bp, Artificial Sequence
  Corresponding array ID: gamma_10_15
accgggtagtttcctacgcgttact

SEQ ID NO: 2496 - DNA, 25 bp, Artificial Sequence
  Corresponding array ID: gamma_10_16
ccactaccgggtagtttcctacgcg

SEQ ID NO: 2497 - DNA, 25 bp, Artificial Sequence
  Corresponding array ID: gamma_10_17
ccccactaccgggtagtttcctacg

SEQ ID NO: 2498 - DNA, 25 bp, Artificial Sequence
  Corresponding array ID: gamma_10_18
ccgggtagtttcctacgcgttactc

SEQ ID NO: 2499 - DNA, 25 bp, Artificial Sequence
  Corresponding array ID: gamma_10_19
cccactaccgggtagtttcctacgc

SEQ ID NO: 2500 - DNA, 25 bp, Artificial Sequence
  Corresponding array ID: gamma_10_20
taccgggtagtttcctacgcgttac

SEQ ID NO: 2501 - DNA, 25 bp, Artificial Sequence
  Corresponding array ID: gamma_10_21
cccccactaccgggtagtttcctac

SEQ ID NO: 2502 - DNA, 25 bp, Artificial Sequence
  Corresponding array ID: gamma_10_22
ctaccgggtagtttcctacgcgtta

SEQ ID NO: 2503 - DNA, 25 bp, Artificial Sequence
  Corresponding array ID: gamma_10_23
ctgttgtcccccactactgggtagt

SEQ ID NO: 2504 - DNA, 25 bp, Artificial Sequence
  Corresponding array ID: gamma_10_24
ctagctaatctcacgcaggcacatc

SEQ ID NO: 2505 - DNA, 25 bp, Artificial Sequence
  Corresponding array ID: gamma_10_25
caactagctaatctcacgcaggcac

SEQ ID NO: 2506 - DNA, 25 bp, Artificial Sequence
  Corresponding array ID: gamma_11_1
gctttcccccgtaggatatatgcgg

SEQ ID NO: 2507 - DNA, 25 bp, Artificial Sequence
  Corresponding array ID: gamma_11_2
ctttcccccgtaggatatatgcggt

SEQ ID NO: 2508 - DNA, 25 bp, Artificial Sequence
  Corresponding array ID: gamma_11_3
tgctttcccccgtaggatatatgcg

SEQ ID NO: 2509 - DNA, 25 bp, Artificial Sequence
  Corresponding array ID: gamma_11_4
ctgctttcccccgtaggatatatgc

SEQ ID NO: 2510 - DNA, 25 bp, Artificial Sequence
  Corresponding array ID: gamma_11_5
cctgctttcccccgtaggatatatg

SEQ ID NO: 2511 - DNA, 25 bp, Artificial Sequence
  Corresponding array ID: gamma_11_6
ccctgctttcccccgtaggatatat

SEQ ID NO: 2512 - DNA, 25 bp, Artificial Sequence
  Corresponding array ID: gamma_11_7
ctcactcaggctcatcaaatagcgc

SEQ ID NO: 2513 - DNA, 25 bp, Artificial Sequence
  Corresponding array ID: gamma_11_8
cccctgctttcccccgtaggatata

SEQ ID NO: 2514 - DNA, 25 bp, Artificial Sequence
  Corresponding array ID: gamma_11_9
gtgtcagtatcgagccagtcagtcg

SEQ ID NO: 2515 - DNA, 25 bp, Artificial Sequence
  Corresponding array ID: gamma_11_10
tcagtgtcagtatcgagccagtcag

SEQ ID NO: 2516 - DNA, 25 bp, Artificial Sequence
  Corresponding array ID: gamma_11_11
agtgtcagtatcgagccagtcagtc

SEQ ID NO: 2517 - DNA, 25 bp, Artificial Sequence
  Corresponding array ID: gamma_11_12
tgtcagtatcgagccagtcagtcgc

SEQ ID NO: 2518 - DNA, 25 bp, Artificial Sequence
  Corresponding array ID: gamma_11_13
cagtgtcagtatcgagccagtcagt

SEQ ID NO: 2519 - DNA, 25 bp, Artificial Sequence
  Corresponding array ID: gamma_11_14
ctcagtgtcagtatcgagccagtca

SEQ ID NO: 2520 - DNA, 25 bp, Artificial Sequence
  Corresponding array ID: gamma_11_15
tcccctgctttcccccgtaggatat

SEQ ID NO: 2521 - DNA, 25 bp, Artificial Sequence
  Corresponding array ID: gamma_11_16
ccccaccaactagctaatctcactc

SEQ ID NO: 2522 - DNA, 25 bp, Artificial Sequence
  Corresponding array ID: gamma_11_17
cctcagtgtcagtatcgagccagtc

SEQ ID NO: 2523 - DNA, 25 bp, Artificial Sequence
  Corresponding array ID: gamma_11_18
gtcccctgctttcccccgtaggata

SEQ ID NO: 2524 - DNA, 25 bp, Artificial Sequence
  Corresponding array ID: gamma_11_19
tcagtatcgagccagtcagtcgcct

SEQ ID NO: 2525 - DNA, 25 bp, Artificial Sequence
  Corresponding array ID: gamma_11_20
gtatcgagccagtcagtcgccttcg

SEQ ID NO: 2526 - DNA, 25 bp, Artificial Sequence
  Corresponding array ID: gamma_11_21
agtatcgagccagtcagtcgccttc

SEQ ID NO: 2527 - DNA, 25 bp, Artificial Sequence
  Corresponding array ID: gamma_11_22
tatcgagccagtcagtcgccttcgc

SEQ ID NO: 2528 - DNA, 25 bp, Artificial Sequence
  Corresponding array ID: gamma_11_23
atcgagccagtcagtcgccttcgcc

SEQ ID NO: 2529 - DNA, 25 bp, Artificial Sequence
  Corresponding array ID: gamma_11_24
gtcagtatcgagccagtcagtcgcc

SEQ ID NO: 2530 - DNA, 25 bp, Artificial Sequence
  Corresponding array ID: gamma_11_25
cagtatcgagccagtcagtcgcctt

SEQ ID NO: 2531 - DNA, 25 bp, Artificial Sequence
  Corresponding array ID: gamma_12_1
cactacctggtagattcctacgcgt

SEQ ID NO: 2532 - DNA, 25 bp, Artificial Sequence
  Corresponding array ID: gamma_12_2
ccactacctggtagattcctacgcg

SEQ ID NO: 2533 - DNA, 25 bp, Artificial Sequence
  Corresponding array ID: gamma_12_3
cccactacctggtagattcctacgc

SEQ ID NO: 2534 - DNA, 25 bp, Artificial Sequence
  Corresponding array ID: gamma_12_4
aactgttgtcccccactacctggta

SEQ ID NO: 2535 - DNA, 25 bp, Artificial Sequence
  Corresponding array ID: gamma_12_5
caactgttgtcccccactacctggt

SEQ ID NO: 2536 - DNA, 25 bp, Artificial Sequence
  Corresponding array ID: gamma_12_6
ccaactgttgtcccccactacctgg

SEQ ID NO: 2537 - DNA, 25 bp, Artificial Sequence
  Corresponding array ID: gamma_12_7
ccccactacctggtagattcctacg

SEQ ID NO: 2538 - DNA, 25 bp, Artificial Sequence
  Corresponding array ID: gamma_12_8
cggtattgcaaccctctgtacgccc

SEQ ID NO: 2539 - DNA, 25 bp, Artificial Sequence
  Corresponding array ID: gamma_12_9
actgttgtcccccactacctggtag

SEQ ID NO: 2540 - DNA, 25 bp, Artificial Sequence
  Corresponding array ID: gamma_12_10
tccaactgttgtcccccactacctg

SEQ ID NO: 2541 - DNA, 25 bp, Artificial Sequence
  Corresponding array ID: gamma_12_11
cccccactacctggtagattcctac

SEQ ID NO: 2542 - DNA, 25 bp, Artificial Sequence
  Corresponding array ID: gamma_12_12
gcggtattgcaaccctctgtacgcc

SEQ ID NO: 2543 - DNA, 25 bp, Artificial Sequence
  Corresponding array ID: gamma_12_13
gcggtatcgcaaccctctgtacgtt

SEQ ID NO: 2544 - DNA, 25 bp, Artificial Sequence
  Corresponding array ID: gamma_12_14
tctatcagtttggggtgcagttccc

SEQ ID NO: 2545 - DNA, 25 bp, Artificial Sequence
  Corresponding array ID: gamma_12_15
gtctatcagtttggggtgcagttcc

SEQ ID NO: 2546 - DNA, 25 bp, Artificial Sequence
  Corresponding array ID: gamma_12_16
ctgttgtcccccactacctggtaga

SEQ ID NO: 2547 - DNA, 25 bp, Artificial Sequence
  Corresponding array ID: gamma_12_17
ctatcagtttggggtgcagttccca

SEQ ID NO: 2548 - DNA, 25 bp, Artificial Sequence
  Corresponding array ID: gamma_12_18
ctgttgctaacgtcacagctaaggg

SEQ ID NO: 2549 - DNA, 25 bp, Artificial Sequence
  Corresponding array ID: gamma_12_19
cagtttggggtgcagttcccaggtt

SEQ ID NO: 2550 - DNA, 25 bp, Artificial Sequence
  Corresponding array ID: gamma_12_20
agtttggggtgcagttcccaggttg

SEQ ID NO: 2551 - DNA, 25 bp, Artificial Sequence
  Corresponding array ID: gamma_12_21
ttccaactgttgtcccccactacct

SEQ ID NO: 2552 - DNA, 25 bp, Artificial Sequence
  Corresponding array ID: gamma_12_22
tatcagtttggggtgcagttcccag

SEQ ID NO: 2553 - DNA, 25 bp, Artificial Sequence
  Corresponding array ID: gamma_12_23
cggtatcgcaaccctctgtacgttc

SEQ ID NO: 2554 - DNA, 25 bp, Artificial Sequence
  Corresponding array ID: gamma_12_24
ccccaccaactaactaatctcacgc

SEQ ID NO: 2555 - DNA, 25 bp, Artificial Sequence
  Corresponding array ID: gamma_12_25
gtcagcgactagcaagctagtcctg

SEQ ID NO: 2556 - DNA, 25 bp, Artificial Sequence
  Corresponding array ID: gamma_13_1
cgccactgaaagacattgtctccca

SEQ ID NO: 2557 - DNA, 25 bp, Artificial Sequence
  Corresponding array ID: gamma_13_2
gcgccactgaaagacattgtctccc

SEQ ID NO: 2558 - DNA, 25 bp, Artificial Sequence
  Corresponding array ID: gamma_13_3
tgcgccactgaaagacattgtctcc

SEQ ID NO: 2559 - DNA, 25 bp, Artificial Sequence
  Corresponding array ID: gamma_13_4
tgtcagtacagatccaggaggccgc

SEQ ID NO: 2560 - DNA, 25 bp, Artificial Sequence
  Corresponding array ID: gamma_13_5
gtgtcagtacagatccaggaggccg

SEQ ID NO: 2561 - DNA, 25 bp, Artificial Sequence
  Corresponding array ID: gamma_13_6
ctgcgccactgaaagacattgtctc

SEQ ID NO: 2562 - DNA, 25 bp, Artificial Sequence
  Corresponding array ID: gamma_13_7
cttggctccaaaaggcacactctca

SEQ ID NO: 2563 - DNA, 25 bp, Artificial Sequence
  Corresponding array ID: gamma_13_8
gagagcttcaagagaggccctcttt

SEQ ID NO: 2564 - DNA, 25 bp, Artificial Sequence
  Corresponding array ID: gamma_13_9
cgagagcttcaagagaggccctctt

SEQ ID NO: 2565 - DNA, 25 bp, Artificial Sequence
  Corresponding array ID: gamma_13_10
gcgagagcttcaagagaggccctct

SEQ ID NO: 2566 - DNA, 25 bp, Artificial Sequence
  Corresponding array ID: gamma_13_11
tagcgagagcttcaagagaggccct

SEQ ID NO: 2567 - DNA, 25 bp, Artificial Sequence
  Corresponding array ID: gamma_13_12
agagcttcaagagaggccctctttc

SEQ ID NO: 2568 - DNA, 25 bp, Artificial Sequence
  Corresponding array ID: gamma_13_13
agcgagagcttcaagagaggccctc

SEQ ID NO: 2569 - DNA, 25 bp, Artificial Sequence
  Corresponding array ID: gamma_13_14
gtcagtacagatccaggaggccgcc

SEQ ID NO: 2570 - DNA, 25 bp, Artificial Sequence
  Corresponding array ID: gamma_13_15
tcagtacagatccaggaggccgcct

SEQ ID NO: 2571 - DNA, 25 bp, Artificial Sequence
  Corresponding array ID: gamma_13_16
cagtacagatccaggaggccgcctt

SEQ ID NO: 2572 - DNA, 25 bp, Artificial Sequence
  Corresponding array ID: gamma_13_17
agtacagatccaggaggccgccttc

SEQ ID NO: 2573 - DNA, 25 bp, Artificial Sequence
  Corresponding array ID: gamma_13_18
gctgcgccactgaaagacattgtct

SEQ ID NO: 2574 - DNA, 25 bp, Artificial Sequence
  Corresponding array ID: gamma_13_19
gagcttcaagagaggccctctttct

SEQ ID NO: 2575 - DNA, 25 bp, Artificial Sequence
  Corresponding array ID: gamma_13_20
tcttggctccaaaaggcacactctc

SEQ ID NO: 2576 - DNA, 25 bp, Artificial Sequence
  Corresponding array ID: gamma_13_21
agtgtcagtacagatccaggaggcc

SEQ ID NO: 2577 - DNA, 25 bp, Artificial Sequence
  Corresponding array ID: gamma_13_22
ggccctctttctcccttaggaggta

SEQ ID NO: 2578 - DNA, 25 bp, Artificial Sequence
  Corresponding array ID: gamma_13_23
agcttcaagagaggccctctttctc

SEQ ID NO: 2579 - DNA, 25 bp, Artificial Sequence
  Corresponding array ID: gamma_13_24
agctgcgccactgaaagacattgtc

SEQ ID NO: 2580 - DNA, 25 bp, Artificial Sequence
  Corresponding array ID: gamma_13_25
cgagagcatcaagagaggccctctt

SEQ ID NO: 2581 - DNA, 25 bp, Artificial Sequence
  Corresponding array ID: gamma_14_1
ggcggtcaacttactacgttagctg

SEQ ID NO: 2582 - DNA, 25 bp, Artificial Sequence
  Corresponding array ID: gamma_14_2
ccaggcggtcaacttactacgttag

SEQ ID NO: 2583 - DNA, 25 bp, Artificial Sequence
  Corresponding array ID: gamma_14_3
gcggtcaacttactacgttagctgc

SEQ ID NO: 2584 - DNA, 25 bp, Artificial Sequence
  Corresponding array ID: gamma_14_4
caggcggtcaacttactacgttagc

SEQ ID NO: 2585 - DNA, 25 bp, Artificial Sequence
  Corresponding array ID: gamma_14_5
cccaggcggtcaacttactacgtta

SEQ ID NO: 2586 - DNA, 25 bp, Artificial Sequence
  Corresponding array ID: gamma_14_6
ccgagggcactgcttcattacaaag

SEQ ID NO: 2587 - DNA, 25 bp, Artificial Sequence
  Corresponding array ID: gamma_14_7
cgagggcactgcttcattacaaagc

SEQ ID NO: 2588 - DNA, 25 bp, Artificial Sequence
  Corresponding array ID: gamma_14_8
tcccgagggcactgcttcattacaa

SEQ ID NO: 2589 - DNA, 25 bp, Artificial Sequence
  Corresponding array ID: gamma_14_9
cccgagggcactgcttcattacaaa

SEQ ID NO: 2590 - DNA, 25 bp, Artificial Sequence
  Corresponding array ID: gamma_14_10
ccccaggcggtcaacttactacgtt

SEQ ID NO: 2591 - DNA, 25 bp, Artificial Sequence
  Corresponding array ID: gamma_14_11
tccccaggcggtcaacttactacgt

SEQ ID NO: 2592 - DNA, 25 bp, Artificial Sequence
  Corresponding array ID: gamma_14_12
ctcccgagggcactgcttcattaca

SEQ ID NO: 2593 - DNA, 25 bp, Artificial Sequence
  Corresponding array ID: gamma_14_13
ctccccaggcggtcaacttactacg

SEQ ID NO: 2594 - DNA, 25 bp, Artificial Sequence
  Corresponding array ID: gamma_14_14
gctcccgagggcactgcttcattac

SEQ ID NO: 2595 - DNA, 25 bp, Artificial Sequence
  Corresponding array ID: gamma_14_15
tcttggctcccgagggcactgcttc

SEQ ID NO: 2596 - DNA, 25 bp, Artificial Sequence
  Corresponding array ID: gamma_14_16
ggctcccgagggcactgcttcatta

SEQ ID NO: 2597 - DNA, 25 bp, Artificial Sequence
  Corresponding array ID: gamma_14_17
tatcttggctcccgagggcactgct

SEQ ID NO: 2598 - DNA, 25 bp, Artificial Sequence
  Corresponding array ID: gamma_14_18
actccccaggcggtcaacttactac

SEQ ID NO: 2599 - DNA, 25 bp, Artificial Sequence
  Corresponding array ID: gamma_14_19
atcttggctcccgagggcactgctt

SEQ ID NO: 2600 - DNA, 25 bp, Artificial Sequence
  Corresponding array ID: gamma_14_20
tactacgttagctgcgccactgaga

SEQ ID NO: 2601 - DNA, 25 bp, Artificial Sequence
  Corresponding array ID: gamma_14_21
gtatcttggctcccgagggcactgc

SEQ ID NO: 2602 - DNA, 25 bp, Artificial Sequence
  Corresponding array ID: gamma_14_22
cttggctcccgagggcactgcttca

SEQ ID NO: 2603 - DNA, 25 bp, Artificial Sequence
  Corresponding array ID: gamma_14_23
tggctcccgagggcactgcttcatt

SEQ ID NO: 2604 - DNA, 25 bp, Artificial Sequence
  Corresponding array ID: gamma_14_24
actacgttagctgcgccactgagaa

SEQ ID NO: 2605 - DNA, 25 bp, Artificial Sequence
  Corresponding array ID: gamma_14_25
ttggctcccgagggcactgcttcat

SEQ ID NO: 2606 - DNA, 25 bp, Artificial Sequence
  Corresponding array ID: gamma_15_1
tccgtagaagtccgggccgtgtctc

SEQ ID NO: 2607 - DNA, 25 bp, Artificial Sequence
  Corresponding array ID: gamma_15_2
ccgtagaagtccgggccgtgtctca

SEQ ID NO: 2608 - DNA, 25 bp, Artificial Sequence
  Corresponding array ID: gamma_15_3
cgtagaagtccgggccgtgtctcag

SEQ ID NO: 2609 - DNA, 25 bp, Artificial Sequence
  Corresponding array ID: gamma_15_4
gtagaagtccgggccgtgtctcagt

SEQ ID NO: 2610 - DNA, 25 bp, Artificial Sequence
  Corresponding array ID: gamma_15_5
ttccgtagaagtccgggccgtgtct

SEQ ID NO: 2611 - DNA, 25 bp, Artificial Sequence
  Corresponding array ID: gamma_15_6
cttccgtagaagtccgggccgtgtc

SEQ ID NO: 2612 - DNA, 25 bp, Artificial Sequence
  Corresponding array ID: gamma_15_7
tagaagtccgggccgtgtctcagtc

SEQ ID NO: 2613 - DNA, 25 bp, Artificial Sequence
  Corresponding array ID: gamma_15_8
actgctgccttccgtagaagtccgg

SEQ ID NO: 2614 - DNA, 25 bp, Artificial Sequence
  Corresponding array ID: gamma_15_9
catgcagtcgagttccagactgcaa

SEQ ID NO: 2615 - DNA, 25 bp, Artificial Sequence
  Corresponding array ID: gamma_15_10
cctcgagctatccccctccattggg

SEQ ID NO: 2616 - DNA, 25 bp, Artificial Sequence
  Corresponding array ID: gamma_15_11
agaagtccgggccgtgtctcagtcc

SEQ ID NO: 2617 - DNA, 25 bp, Artificial Sequence
  Corresponding array ID: gamma_15_12
tcctcgagctatccccctccattgg

SEQ ID NO: 2618 - DNA, 25 bp, Artificial Sequence
  Corresponding array ID: gamma_15_13
ctcgagctatccccctccattgggt

SEQ ID NO: 2619 - DNA, 25 bp, Artificial Sequence
  Corresponding array ID: gamma_15_14
tcatgcagtcgagttccagactgca

SEQ ID NO: 2620 - DNA, 25 bp, Artificial Sequence
  Corresponding array ID: gamma_15_15
ccttccgtagaagtccgggccgtgt

SEQ ID NO: 2621 - DNA, 25 bp, Artificial Sequence
  Corresponding array ID: gamma_15_16
gcgccactggataaatccaacggct

SEQ ID NO: 2622 - DNA, 25 bp, Artificial Sequence
  Corresponding array ID: gamma_15_17
tgcgccactggataaatccaacggc

SEQ ID NO: 2623 - DNA, 25 bp, Artificial Sequence
  Corresponding array ID: gamma_15_18
ttcctcgagctatccccctccattg

SEQ ID NO: 2624 - DNA, 25 bp, Artificial Sequence
  Corresponding array ID: gamma_15_19
gttccagactgcaattcggactacg

SEQ ID NO: 2625 - DNA, 25 bp, Artificial Sequence
  Corresponding array ID: gamma_15_20
ccagctcgcgctttggcaaccgttt

SEQ ID NO: 2626 - DNA, 25 bp, Artificial Sequence
  Corresponding array ID: gamma_15_21
tcgagctatccccctccattgggta

SEQ ID NO: 2627 - DNA, 25 bp, Artificial Sequence
  Corresponding array ID: gamma_15_22
gctgcgccactggataaatccaacg

SEQ ID NO: 2628 - DNA, 25 bp, Artificial Sequence
  Corresponding array ID: gamma_15_23
cgccactggataaatccaacggcta

SEQ ID NO: 2629 - DNA, 25 bp, Artificial Sequence
  Corresponding array ID: gamma_15_24
ctgcgccactggataaatccaacgg

SEQ ID NO: 2630 - DNA, 25 bp, Artificial Sequence
  Corresponding array ID: gamma_15_25
tttcctcgagctatccccctccatt

SEQ ID NO: 2631 - DNA, 25 bp, Artificial Sequence
  Corresponding array ID: gamma_16_1
tttaagggtttggctccagctcgcg

SEQ ID NO: 2632 - DNA, 25 bp, Artificial Sequence
  Corresponding array ID: gamma_16_2
ttttaagggtttggctccagctcgc

SEQ ID NO: 2633 - DNA, 25 bp, Artificial Sequence
  Corresponding array ID: gamma_16_3
ttaagggtttggctccagctcgcgc

SEQ ID NO: 2634 - DNA, 25 bp, Artificial Sequence
  Corresponding array ID: gamma_16_4
gttttaagggtttggctccagctcg

SEQ ID NO: 2635 - DNA, 25 bp, Artificial Sequence
  Corresponding array ID: gamma_16_5
cacgcggtatacctggatcagggtt

SEQ ID NO: 2636 - DNA, 25 bp, Artificial Sequence
  Corresponding array ID: gamma_16_6
acacgcggtatacctggatcagggt

SEQ ID NO: 2637 - DNA, 25 bp, Artificial Sequence
  Corresponding array ID: gamma_16_7
cttcctccgggtttcacccggcagt

SEQ ID NO: 2638 - DNA, 25 bp, Artificial Sequence
  Corresponding array ID: gamma_16_8
tcctccgggtttcacccggcagtct

SEQ ID NO: 2639 - DNA, 25 bp, Artificial Sequence
  Corresponding array ID: gamma_16_9
cttcacacacgcggtatacctggat

SEQ ID NO: 2640 - DNA, 25 bp, Artificial Sequence
  Corresponding array ID: gamma_16_10
cacacgcggtatacctggatcaggg

SEQ ID NO: 2641 - DNA, 25 bp, Artificial Sequence
  Corresponding array ID: gamma_16_11
acacacgcggtatacctggatcagg

SEQ ID NO: 2642 - DNA, 25 bp, Artificial Sequence
  Corresponding array ID: gamma_16_12
cacacacgcggtatacctggatcag

SEQ ID NO: 2643 - DNA, 25 bp, Artificial Sequence
  Corresponding array ID: gamma_16_13
ccttcctccgggtttcacccggcag

SEQ ID NO: 2644 - DNA, 25 bp, Artificial Sequence
  Corresponding array ID: gamma_16_14
ttcctccgggtttcacccggcagtc

SEQ ID NO: 2645 - DNA, 25 bp, Artificial Sequence
  Corresponding array ID: gamma_16_15
cctccgggtttcacccggcagtctc

SEQ ID NO: 2646 - DNA, 25 bp, Artificial Sequence
  Corresponding array ID: gamma_16_16
ttcacacacgcggtatacctggatc

SEQ ID NO: 2647 - DNA, 25 bp, Artificial Sequence
  Corresponding array ID: gamma_16_17
cgccttcctccgggtttcacccggc

SEQ ID NO: 2648 - DNA, 25 bp, Artificial Sequence
  Corresponding array ID: gamma_16_18
ctccgggtttcacccggcagtctcc

SEQ ID NO: 2649 - DNA, 25 bp, Artificial Sequence
  Corresponding array ID: gamma_16_19
gcggtatacctggatcagggttgcc

SEQ ID NO: 2650 - DNA, 25 bp, Artificial Sequence
  Corresponding array ID: gamma_16_20
cggtatacctggatcagggttgccc

SEQ ID NO: 2651 - DNA, 25 bp, Artificial Sequence
  Corresponding array ID: gamma_16_21
ggtatacctggatcagggttgcccc

SEQ ID NO: 2652 - DNA, 25 bp, Artificial Sequence
  Corresponding array ID: gamma_16_22
tcttcacacacgcggtatacctgga

SEQ ID NO: 2653 - DNA, 25 bp, Artificial Sequence
  Corresponding array ID: gamma_16_23
tcacacacgcggtatacctggatca

SEQ ID NO: 2654 - DNA, 25 bp, Artificial Sequence
  Corresponding array ID: gamma_16_24
gccttcctccgggtttcacccggca

SEQ ID NO: 2655 - DNA, 25 bp, Artificial Sequence
  Corresponding array ID: gamma_16_25
cgcggtatacctggatcagggttgc

SEQ ID NO: 2656 - DNA, 25 bp, Artificial Sequence
  Corresponding array ID: gamma_17_1
ggctcctccaatagtgaccggtccg

SEQ ID NO: 2657 - DNA, 25 bp, Artificial Sequence
  Corresponding array ID: gamma_17_2
aggctcctccaatagtgaccggtcc

SEQ ID NO: 2658 - DNA, 25 bp, Artificial Sequence
  Corresponding array ID: gamma_17_3
caggctcctccaatagtgaccggtc

SEQ ID NO: 2659 - DNA, 25 bp, Artificial Sequence
  Corresponding array ID: gamma_17_4
catgtattaggcctgccgccaacgt

SEQ ID NO: 2660 - DNA, 25 bp, Artificial Sequence
  Corresponding array ID: gamma_17_5
gctcctccaatagtgaccggtccga

SEQ ID NO: 2661 - DNA, 25 bp, Artificial Sequence
  Corresponding array ID: gamma_17_6
gcaggctcctccaatagtgaccggt

SEQ ID NO: 2662 - DNA, 25 bp, Artificial Sequence
  Corresponding array ID: gamma_17_7
cgcctgagagcaagctcccatcgtt

SEQ ID NO: 2663 - DNA, 25 bp, Artificial Sequence
  Corresponding array ID: gamma_17_8
acgcctgagagcaagctcccatcgt

SEQ ID NO: 2664 - DNA, 25 bp, Artificial Sequence
  Corresponding array ID: gamma_17_9
gcctgagagcaagctcccatcgttt

SEQ ID NO: 2665 - DNA, 25 bp, Artificial Sequence
  Corresponding array ID: gamma_17_10
gacgcctgagagcaagctcccatcg

SEQ ID NO: 2666 - DNA, 25 bp, Artificial Sequence
  Corresponding array ID: gamma_17_11
aatcctacgcaggctcctccaatag

SEQ ID NO: 2667 - DNA, 25 bp, Artificial Sequence
  Corresponding array ID: gamma_17_12
gcatgtattaggcctgccgccaacg

SEQ ID NO: 2668 - DNA, 25 bp, Artificial Sequence
  Corresponding array ID: gamma_17_13
ctaatcctacgcaggctcctccaat

SEQ ID NO: 2669 - DNA, 25 bp, Artificial Sequence
  Corresponding array ID: gamma_17_14
gctaatcctacgcaggctcctccaa

SEQ ID NO: 2670 - DNA, 25 bp, Artificial Sequence
  Corresponding array ID: gamma_17_15
cgacgcctgagagcaagctcccatc

SEQ ID NO: 2671 - DNA, 25 bp, Artificial Sequence
  Corresponding array ID: gamma_17_16
cctgagagcaagctcccatcgtttc

SEQ ID NO: 2672 - DNA, 25 bp, Artificial Sequence
  Corresponding array ID: gamma_17_17
ctcctccaatagtgaccggtccgaa

SEQ ID NO: 2673 - DNA, 25 bp, Artificial Sequence
  Corresponding array ID: gamma_17_18
atcctacgcaggctcctccaatagt

SEQ ID NO: 2674 - DNA, 25 bp, Artificial Sequence
  Corresponding array ID: gamma_17_19
cgcaggctcctccaatagtgaccgg

SEQ ID NO: 2675 - DNA, 25 bp, Artificial Sequence
  Corresponding array ID: gamma_17_20
agctaatcctacgcaggctcctcca

SEQ ID NO: 2676 - DNA, 25 bp, Artificial Sequence
  Corresponding array ID: gamma_17_21
tcgacgcctgagagcaagctcccat

SEQ ID NO: 2677 - DNA, 25 bp, Artificial Sequence
  Corresponding array ID: gamma_17_22
ctgagagcaagctcccatcgtttcc

SEQ ID NO: 2678 - DNA, 25 bp, Artificial Sequence
  Corresponding array ID: gamma_17_23
tgtattaggcctgccgccaacgttc

SEQ ID NO: 2679 - DNA, 25 bp, Artificial Sequence
  Corresponding array ID: gamma_17_24
tgcatgtattaggcctgccgccaac

SEQ ID NO: 2680 - DNA, 25 bp, Artificial Sequence
  Corresponding array ID: gamma_17_25
cgccaccggtattcctcagaatatc

SEQ ID NO: 2681 - DNA, 25 bp, Artificial Sequence
  Corresponding array ID: gamma_19_1
gaggttgcgaccctttgtccttccc

SEQ ID NO: 2682 - DNA, 25 bp, Artificial Sequence
  Corresponding array ID: gamma_19_2
gcgaggttgcgaccctttgtccttc

SEQ ID NO: 2683 - DNA, 25 bp, Artificial Sequence
  Corresponding array ID: gamma_19_3
cgaaacctttcaagaagagggctcc

SEQ ID NO: 2684 - DNA, 25 bp, Artificial Sequence
  Corresponding array ID: gamma_19_4
aaagtggtgagcgcccagataagct

SEQ ID NO: 2685 - DNA, 25 bp, Artificial Sequence
  Corresponding array ID: gamma_19_5
tgagcgcccagataagctacccact

SEQ ID NO: 2686 - DNA, 25 bp, Artificial Sequence
  Corresponding array ID: gamma_19_6
caaagtggtgagcgcccagataagc

SEQ ID NO: 2687 - DNA, 25 bp, Artificial Sequence
  Corresponding array ID: gamma_19_7
gtggtgagcgcccagataagctacc

SEQ ID NO: 2688 - DNA, 25 bp, Artificial Sequence
  Corresponding array ID: gamma_19_8
agtggtgagcgcccagataagctac

SEQ ID NO: 2689 - DNA, 25 bp, Artificial Sequence
  Corresponding array ID: gamma_19_9
gtgagcgcccagataagctacccac

SEQ ID NO: 2690 - DNA, 25 bp, Artificial Sequence
  Corresponding array ID: gamma_19_10
ggtgagcgcccagataagctaccca

SEQ ID NO: 2691 - DNA, 25 bp, Artificial Sequence
  Corresponding array ID: gamma_19_11
tggtgagcgcccagataagctaccc

SEQ ID NO: 2692 - DNA, 25 bp, Artificial Sequence
  Corresponding array ID: gamma_19_12
aagtggtgagcgcccagataagcta

SEQ ID NO: 2693 - DNA, 25 bp, Artificial Sequence
  Corresponding array ID: gamma_19_13
cgcccagataagctacccacttctt

SEQ ID NO: 2694 - DNA, 25 bp, Artificial Sequence
  Corresponding array ID: gamma_19_14
gcgcccagataagctacccacttct

SEQ ID NO: 2695 - DNA, 25 bp, Artificial Sequence
  Corresponding array ID: gamma_19_15
gcgaaacctttcaagaagagggctc

SEQ ID NO: 2696 - DNA, 25 bp, Artificial Sequence
  Corresponding array ID: gamma_19_16
agcgcccagataagctacccacttc

SEQ ID NO: 2697 - DNA, 25 bp, Artificial Sequence
  Corresponding array ID: gamma_19_17
acaaagtggtgagcgcccagataag

SEQ ID NO: 2698 - DNA, 25 bp, Artificial Sequence
  Corresponding array ID: gamma_19_18
cacaaagtggtgagcgcccagataa

SEQ ID NO: 2699 - DNA, 25 bp, Artificial Sequence
  Corresponding array ID: gamma_19_19
cgaggttgcgaccctttgtccttcc

SEQ ID NO: 2700 - DNA, 25 bp, Artificial Sequence
  Corresponding array ID: gamma_19_20
gagcgcccagataagctacccactt

SEQ ID NO: 2701 - DNA, 25 bp, Artificial Sequence
  Corresponding array ID: gamma_19_21
cgcgaggttgcgaccctttgtcctt

SEQ ID NO: 2702 - DNA, 25 bp, Artificial Sequence
  Corresponding array ID: gamma_19_22
gacgcctaagagcaagctcttatcg

SEQ ID NO: 2703 - DNA, 25 bp, Artificial Sequence
  Corresponding array ID: gamma_19_23
tcacaaagtggtgagcgcccagata

SEQ ID NO: 2704 - DNA, 25 bp, Artificial Sequence
  Corresponding array ID: gamma_19_24
gcaggctcatctgatagcgaaacct

SEQ ID NO: 2705 - DNA, 25 bp, Artificial Sequence
  Corresponding array ID: gamma_19_25
cgacgcctaagagcaagctcttatc

SEQ ID NO: 2706 - DNA, 25 bp, Artificial Sequence
  Corresponding array ID: gamma_20_1
ccactaagggacaaattcccccaac

SEQ ID NO: 2707 - DNA, 25 bp, Artificial Sequence
  Corresponding array ID: gamma_20_2
cgccactaagggacaaattccccca

SEQ ID NO: 2708 - DNA, 25 bp, Artificial Sequence
  Corresponding array ID: gamma_20_3
gccactaagggacaaattcccccaa

SEQ ID NO: 2709 - DNA, 25 bp, Artificial Sequence
  Corresponding array ID: gamma_20_4
cactaagggacaaattcccccaacg

SEQ ID NO: 2710 - DNA, 25 bp, Artificial Sequence
  Corresponding array ID: gamma_20_5
actaagggacaaattcccccaacgg

SEQ ID NO: 2711 - DNA, 25 bp, Artificial Sequence
  Corresponding array ID: gamma_20_6
ctaagggacaaattcccccaacggc

SEQ ID NO: 2712 - DNA, 25 bp, Artificial Sequence
  Corresponding array ID: gamma_20_7
gcgccactaagggacaaattccccc

SEQ ID NO: 2713 - DNA, 25 bp, Artificial Sequence
  Corresponding array ID: gamma_20_8
ggtaccgtcaagacgcgcagttatt

SEQ ID NO: 2714 - DNA, 25 bp, Artificial Sequence
  Corresponding array ID: gamma_20_9
aggtaccgtcaagacgcgcagttat

SEQ ID NO: 2715 - DNA, 25 bp, Artificial Sequence
  Corresponding array ID: gamma_20_10
taggtaccgtcaagacgcgcagtta

SEQ ID NO: 2716 - DNA, 25 bp, Artificial Sequence
  Corresponding array ID: gamma_20_11
tgcgccactaagggacaaattcccc

SEQ ID NO: 2717 - DNA, 25 bp, Artificial Sequence
  Corresponding array ID: gamma_20_12
taagggacaaattcccccaacggct

SEQ ID NO: 2718 - DNA, 25 bp, Artificial Sequence
  Corresponding array ID: gamma_20_13
ctgtaggtaccgtcaagacgcgcag

SEQ ID NO: 2719 - DNA, 25 bp, Artificial Sequence
  Corresponding array ID: gamma_20_14
gtaggtaccgtcaagacgcgcagtt

SEQ ID NO: 2720 - DNA, 25 bp, Artificial Sequence
  Corresponding array ID: gamma_20_15
ctgcgccactaagggacaaattccc

SEQ ID NO: 2721 - DNA, 25 bp, Artificial Sequence
  Corresponding array ID: gamma_20_16
tgtaggtaccgtcaagacgcgcagt

SEQ ID NO: 2722 - DNA, 25 bp, Artificial Sequence
  Corresponding array ID: gamma_20_17
tctgtaggtaccgtcaagacgcgca

SEQ ID NO: 2723 - DNA, 25 bp, Artificial Sequence
  Corresponding array ID: gamma_20_18
gctgcgccactaagggacaaattcc

SEQ ID NO: 2724 - DNA, 25 bp, Artificial Sequence
  Corresponding array ID: gamma_20_19
cttctgtaggtaccgtcaagacgcg

SEQ ID NO: 2725 - DNA, 25 bp, Artificial Sequence
  Corresponding array ID: gamma_20_20
tcttctgtaggtaccgtcaagacgc

SEQ ID NO: 2726 - DNA, 25 bp, Artificial Sequence
  Corresponding array ID: gamma_20_21
ggacaaattcccccaacggctagtt

SEQ ID NO: 2727 - DNA, 25 bp, Artificial Sequence
  Corresponding array ID: gamma_20_22
gacaaattcccccaacggctagttg

SEQ ID NO: 2728 - DNA, 25 bp, Artificial Sequence
  Corresponding array ID: gamma_20_23
agctgcgccactaagggacaaattc

SEQ ID NO: 2729 - DNA, 25 bp, Artificial Sequence
  Corresponding array ID: gamma_20_24
cgttacgcacccgtccgccactcga

SEQ ID NO: 2730 - DNA, 25 bp, Artificial Sequence
  Corresponding array ID: gamma_20_25
tcgcgttagctgcgccactaaggga

SEQ ID NO: 2731 - DNA, 25 bp, Artificial Sequence
  Corresponding array ID: gamma_21_1
tcgtcagcgcagagcaagctccgcc

SEQ ID NO: 2732 - DNA, 25 bp, Artificial Sequence
  Corresponding array ID: gamma_21_2
ctcgtcagcgcagagcaagctccgc

SEQ ID NO: 2733 - DNA, 25 bp, Artificial Sequence
  Corresponding array ID: gamma_21_3
actcgtcagcgcagagcaagctccg

SEQ ID NO: 2734 - DNA, 25 bp, Artificial Sequence
  Corresponding array ID: gamma_21_4
agcaagctccgcctgttaccgttcg

SEQ ID NO: 2735 - DNA, 25 bp, Artificial Sequence
  Corresponding array ID: gamma_21_5
gtcagcgcagagcaagctccgcctg

SEQ ID NO: 2736 - DNA, 25 bp, Artificial Sequence
  Corresponding array ID: gamma_21_6
gagcaagctccgcctgttaccgttc

SEQ ID NO: 2737 - DNA, 25 bp, Artificial Sequence
  Corresponding array ID: gamma_21_7
caagctccgcctgttaccgttcgac

SEQ ID NO: 2738 - DNA, 25 bp, Artificial Sequence
  Corresponding array ID: gamma_21_8
gctccgcctgttaccgttcgacttg

SEQ ID NO: 2739 - DNA, 25 bp, Artificial Sequence
  Corresponding array ID: gamma_21_9
ctgggctttcacatccgactgaccg

SEQ ID NO: 2740 - DNA, 25 bp, Artificial Sequence
  Corresponding array ID: gamma_21_10
cttttgcaagccactcccatggtgt

SEQ ID NO: 2741 - DNA, 25 bp, Artificial Sequence
  Corresponding array ID: gamma_21_11
tcttttgcaagccactcccatggtg

SEQ ID NO: 2742 - DNA, 25 bp, Artificial Sequence
  Corresponding array ID: gamma_21_12
cttcttttgcaagccactcccatgg

SEQ ID NO: 2743 - DNA, 25 bp, Artificial Sequence
  Corresponding array ID: gamma_21_13
ttttgcaagccactcccatggtgtg

SEQ ID NO: 2744 - DNA, 25 bp, Artificial Sequence
  Corresponding array ID: gamma_21_14
tttgcaagccactcccatggtgtga

SEQ ID NO: 2745 - DNA, 25 bp, Artificial Sequence
  Corresponding array ID: gamma_21_15
cctcagcgtcagtattgctccagaa

SEQ ID NO: 2746 - DNA, 25 bp, Artificial Sequence
  Corresponding array ID: gamma_21_16
gggctttcacatccgactgaccgtg

SEQ ID NO: 2747 - DNA, 25 bp, Artificial Sequence
  Corresponding array ID: gamma_21_17
ctttcacatccgactgaccgtgccg

SEQ ID NO: 2748 - DNA, 25 bp, Artificial Sequence
  Corresponding array ID: gamma_21_18
ggctttcacatccgactgaccgtgc

SEQ ID NO: 2749 - DNA, 25 bp, Artificial Sequence
  Corresponding array ID: gamma_21_19
cactcgtcagcgcagagcaagctcc

SEQ ID NO: 2750 - DNA, 25 bp, Artificial Sequence
  Corresponding array ID: gamma_21_20
gctttcacatccgactgaccgtgcc

SEQ ID NO: 2751 - DNA, 25 bp, Artificial Sequence
  Corresponding array ID: gamma_21_21
tcagcgcagagcaagctccgcctgt

SEQ ID NO: 2752 - DNA, 25 bp, Artificial Sequence
  Corresponding array ID: gamma_21_22
cgtcagcgcagagcaagctccgcct

SEQ ID NO: 2753 - DNA, 25 bp, Artificial Sequence
  Corresponding array ID: gamma_21_23
agagcaagctccgcctgttaccgtt

SEQ ID NO: 2754 - DNA, 25 bp, Artificial Sequence
  Corresponding array ID: gamma_21_24
agctccgcctgttaccgttcgactt

SEQ ID NO: 2755 - DNA, 25 bp, Artificial Sequence
  Corresponding array ID: gamma_21_25
cagagcaagctccgcctgttaccgt

SEQ ID NO: 2756 - DNA, 25 bp, Artificial Sequence
  Corresponding array ID: verru_1_1
ccccgagatttcacacctcacacat

SEQ ID NO: 2757 - DNA, 25 bp, Artificial Sequence
  Corresponding array ID: verru_1_2
cccgagatttcacacctcacacatc

SEQ ID NO: 2758 - DNA, 25 bp, Artificial Sequence
  Corresponding array ID: verru_1_3
tcacacctcacacatctatccgcct

SEQ ID NO: 2759 - DNA, 25 bp, Artificial Sequence
  Corresponding array ID: verru_1_4
cacctcacacatctatccgcctacg

SEQ ID NO: 2760 - DNA, 25 bp, Artificial Sequence
  Corresponding array ID: verru_1_5
ttcacacctcacacatctatccgcc

SEQ ID NO: 2761 - DNA, 25 bp, Artificial Sequence
  Corresponding array ID: verru_1_6
acacctcacacatctatccgcctac

SEQ ID NO: 2762 - DNA, 25 bp, Artificial Sequence
  Corresponding array ID: verru_1_7
cacacctcacacatctatccgccta

SEQ ID NO: 2763 - DNA, 25 bp, Artificial Sequence
  Corresponding array ID: verru_1_8
gccccgagatttcacacctcacaca

SEQ ID NO: 2764 - DNA, 25 bp, Artificial Sequence
  Corresponding array ID: verru_1_9
acctcacacatctatccgcctacgc

SEQ ID NO: 2765 - DNA, 25 bp, Artificial Sequence
  Corresponding array ID: verru_1_10
agccccgagatttcacacctcacac

SEQ ID NO: 2766 - DNA, 25 bp, Artificial Sequence
  Corresponding array ID: verru_1_11
ctcccgaaggatagctcacgtactt

SEQ ID NO: 2767 - DNA, 25 bp, Artificial Sequence
  Corresponding array ID: verru_1_12
ctgcctcccgaaggatagctcacgt

SEQ ID NO: 2768 - DNA, 25 bp, Artificial Sequence
  Corresponding array ID: verru_1_13
ggctatgaacctccttgttgctcct

SEQ ID NO: 2769 - DNA, 25 bp, Artificial Sequence
  Corresponding array ID: verru_1_14
cctcccgaaggatagctcacgtact

SEQ ID NO: 2770 - DNA, 25 bp, Artificial Sequence
  Corresponding array ID: verru_1_15
cccgaaggatagctcacgtacttcg

SEQ ID NO: 2771 - DNA, 25 bp, Artificial Sequence
  Corresponding array ID: verru_1_16
tcccgaaggatagctcacgtacttc

SEQ ID NO: 2772 - DNA, 25 bp, Artificial Sequence
  Corresponding array ID: verru_1_17
gaggctatgaacctccttgttgctc

SEQ ID NO: 2773 - DNA, 25 bp, Artificial Sequence
  Corresponding array ID: verru_1_18
gacgctgcctcccgaaggatagctc

SEQ ID NO: 2774 - DNA, 25 bp, Artificial Sequence
  Corresponding array ID: verru_1_19
aggctatgaacctccttgttgctcc

SEQ ID NO: 2775 - DNA, 25 bp, Artificial Sequence
  Corresponding array ID: verru_1_20
gcctcccgaaggatagctcacgtac

SEQ ID NO: 2776 - DNA, 25 bp, Artificial Sequence
  Corresponding array ID: verru_1_21
cgctgcctcccgaaggatagctcac

SEQ ID NO: 2777 - DNA, 25 bp, Artificial Sequence
  Corresponding array ID: verru_1_22
tgcctcccgaaggatagctcacgta

SEQ ID NO: 2778 - DNA, 25 bp, Artificial Sequence
  Corresponding array ID: verru_1_23
acgctgcctcccgaaggatagctca

SEQ ID NO: 2779 - DNA, 25 bp, Artificial Sequence
  Corresponding array ID: verru_1_24
gctgcctcccgaaggatagctcacg

SEQ ID NO: 2780 - DNA, 25 bp, Artificial Sequence
  Corresponding array ID: verru_1_25
aggacgctgcctcccgaaggatagc

SEQ ID NO: 2781 - DNA, 25 bp, Artificial Sequence
  Corresponding array ID: verru_2_1
cgtcgcatgttcacactttcgtgca

SEQ ID NO: 2782 - DNA, 25 bp, Artificial Sequence
  Corresponding array ID: verru_2_2
ctaccctaactttcgtccatgagcg

SEQ ID NO: 2783 - DNA, 25 bp, Artificial Sequence
  Corresponding array ID: verru_2_3
accctaactttcgtccatgagcgtc

SEQ ID NO: 2784 - DNA, 25 bp, Artificial Sequence
  Corresponding array ID: verru_2_4
gcgtcgcatgttcacactttcgtgc

SEQ ID NO: 2785 - DNA, 25 bp, Artificial Sequence
  Corresponding array ID: verru_2_5
caagtgttcccttctcccctccagt

SEQ ID NO: 2786 - DNA, 25 bp, Artificial Sequence
  Corresponding array ID: verru_2_6
tacaccaagtgttcccttctcccct

SEQ ID NO: 2787 - DNA, 25 bp, Artificial Sequence
  Corresponding array ID: verru_2_7
ccaagtgttcccttctcccctccag

SEQ ID NO: 2788 - DNA, 25 bp, Artificial Sequence
  Corresponding array ID: verru_2_8
acaccaagtgttcccttctcccctc

SEQ ID NO: 2789 - DNA, 25 bp, Artificial Sequence
  Corresponding array ID: verru_2_9
cgctacaccaagtgttcccttctcc

SEQ ID NO: 2790 - DNA, 25 bp, Artificial Sequence
  Corresponding array ID: verru_2_10
caccaagtgttcccttctcccctcc

SEQ ID NO: 2791 - DNA, 25 bp, Artificial Sequence
  Corresponding array ID: verru_2_11
gctacaccaagtgttcccttctccc

SEQ ID NO: 2792 - DNA, 25 bp, Artificial Sequence
  Corresponding array ID: verru_2_12
ctacaccaagtgttcccttctcccc

SEQ ID NO: 2793 - DNA, 25 bp, Artificial Sequence
  Corresponding array ID: verru_2_13
agtgttcccttctcccctccagtac

SEQ ID NO: 2794 - DNA, 25 bp, Artificial Sequence
  Corresponding array ID: verru_2_14
aagtgttcccttctcccctccagta

SEQ ID NO: 2795 - DNA, 25 bp, Artificial Sequence
  Corresponding array ID: verru_2_15
accaagtgttcccttctcccctcca

SEQ ID NO: 2796 - DNA, 25 bp, Artificial Sequence
  Corresponding array ID: verru_2_16
gctaccctaactttcgtccatgagc

SEQ ID NO: 2797 - DNA, 25 bp, Artificial Sequence
  Corresponding array ID: verru_2_17
gttcccttctcccctccagtactct

SEQ ID NO: 2798 - DNA, 25 bp, Artificial Sequence
  Corresponding array ID: verru_2_18
gtgttcccttctcccctccagtact

SEQ ID NO: 2799 - DNA, 25 bp, Artificial Sequence
  Corresponding array ID: verru_2_19
tgttcccttctcccctccagtactc

SEQ ID NO: 2800 - DNA, 25 bp, Artificial Sequence
  Corresponding array ID: verru_2_20
ccgctacaccaagtgttcccttctc

SEQ ID NO: 2801 - DNA, 25 bp, Artificial Sequence
  Corresponding array ID: verru_2_21
ttcccttctcccctccagtactcta

SEQ ID NO: 2802 - DNA, 25 bp, Artificial Sequence
  Corresponding array ID: verru_2_22
ggcgtcgcatgttcacactttcgtg

SEQ ID NO: 2803 - DNA, 25 bp, Artificial Sequence
  Corresponding array ID: verru_2_23
cgctaccctaactttcgtccatgag

SEQ ID NO: 2804 - DNA, 25 bp, Artificial Sequence
  Corresponding array ID: verru_2_24
ccctaactttcgtccatgagcgtca

SEQ ID NO: 2805 - DNA, 25 bp, Artificial Sequence
  Corresponding array ID: verru_2_25
accgctacaccaagtgttcccttct

What is claimed is:

1. A method for determination of stable isotope incorporation in a community of organisms comprising the steps of:
   a) supplying said community of organisms with at least two substrates simultaneously for a defined period of time, wherein each of the at least two substrates is labeled with a different stable isotope;
   b) extracting RNA from the organisms;
   c) fragmenting said RNA to provide fragmented RNA;
   d) labeling a fraction of the fragmented RNA with a detectable label to provide labeled fragmented RNA;
   e) hybridizing the labeled fragmented RNA to a set of oligonucleotide probes, wherein the set of oligonucleotide probes is an array of oligonucleotide probes attached to a substrate;
   f) detecting hybridization signal strength of labeled fragmented RNA hybridized to the oligonucleotide probes to determine the community organism composition;
   g) identifying a responsive set of oligonucleotide probes based on the hybridization signal strength in step f);
   h) hybridizing a fraction of unlabeled fragmented RNA to a second array of oligonucleotide probes, wherein the second array comprises the responsive set of oligonucleotide probes attached to a conductive substrate;
   i) detecting the unlabeled fragmented RNA hybridized to the responsive set of probes to determine the stable isotope incorporation into the community of organisms using imaging mass spectrometry or spectroscopy.

2. The method of claim 1, wherein said organism is a bacterium, archaea, virus, fungus, plant, arthropod, nematode, or other eukaryote.

3. The method of claim 2, wherein said organism is a bacterium.

4. The method of claim 1, wherein the stable isotopes are selected from the group consisting of $^3H$, $^{13}C$, $^{15}N$, and $^{18}O$.

5. The method of claim 1, wherein in step b) the extracting step is carried out by physical or chemical cell lysis followed by affinity column purification.

6. The method of claim 1, wherein in step c) the fragmenting step is carried out by using enzymes, chemicals, or heat, or a combination of these.

7. The method of claim 1, wherein in step d) the RNA is labeled with a fluorescent molecule or a non-fluorescent molecule.

8. The method of claim 1, wherein steps c) and d) are carried out concurrently.

9. The method of claim 1, wherein step e) further comprises the steps of adding said labeled fragmented RNA to a hybridization solution and contacting said hybridization solution with the array of oligonucleotide probes.

10. The method of claim 1, wherein the set of oligonucleotide probes comprises 16S rRNA phylogenetic oligonucleotide probes.

11. The method of claim 10, wherein said set of 16S rRNA phylogenetic probes further comprises probes from the 16S rRNA gene, 23S rRNA gene, 5S rRNA gene, 5.8S rRNA gene, 12S rRNA gene, 18S rRNA gene, 28S rRNA gene, gyrB gene, rpoB gene, fusA gene, recA gene, cox1 gene, nif13 gene, or a combination thereof.

12. The method of claim 7, wherein the RNA is labeled with a fluorescent molecule.

13. The method of claim 7, wherein the RNA is labeled with a non-fluorescent molecule.

14. The method of claim 1, wherein in step f) the hybridized labeled RNA is imaged with a fluorescence scanner and fluorescence intensity is measured for each probe feature.

15. The method of claim 1, wherein in step f) the detection of hybridization signal strength provides a determination of genes present in the community of organisms.

16. The method of claim 1, wherein in step f) the detection of hybridization signal strength is used for normalization of the isotope signals detected in step i).

17. The method of claim 1, wherein in step i) the hybridized unlabeled fragmented RNA are imaged with a secondary ion mass spectrometer and isotope ratios are measured for each probe feature.

18. The method of claim 1, wherein in step i) the hybridized unlabeled fragmented RNA are imaged with a nano-scale secondary ion mass spectrometer device and isotope ratios are measured for each probe feature.

19. The method of claim 1, wherein in step e) the substrate is a solid planar substrate, a microarray slide, spheres or beads, wherein the substrate is comprised of silicon, glass, metals, semiconductor materials, polymers or plastics.

20. The method of claim 18, wherein in step h) the responsive probe substrate is a solid planar substrate, a microarray slide, spheres or beads, wherein the responsive probe substrate is comprised of silicon, glass, metals, semiconductor materials, polymers or plastics.

21. The method of claim 20, wherein the responsive probe substrate is a solid planar substrate coated with indium tin oxide (ITO).

22. The method of claim 1, wherein in step e) the set of oligonucleotide probes is identified and selected from unique sequence regions of the fragmented RNA.

23. A method for determination of stable isotope incorporation in a community of organisms comprising the steps of:
   a) supplying said community of organisms with at least two substrates simultaneously for a defined period of time, wherein each of the at least two substrates is labeled with a different stable isotope;
   b) extracting RNA from the organisms;
   c) fragmenting said RNA to provide fragmented RNA, generating cDNAs from a fraction of said fragmented RNA and sequencing said cDNAs;

d) designing a first set of oligonucleotide probes based on unique sequence regions of said sequenced cDNAs generated from the fragmented RNA;

e) labeling a fraction of the fragmented RNA with a detectable label to provide labeled fragmented RNA;

f) hybridizing the labeled fragmented RNA to the first set of oligonucleotide probes, wherein the first set of oligonucleotide probes is an array of oligonucleotide probes attached to a substrate, and detecting hybridization signal strength of the labeled fragmented RNA hybridized to the first set of oligonucleotide probes to determine the community organism composition;

g) identifying a responsive set of oligonucleotide probes based on the hybridization signal strength in step f);

h) hybridizing a fraction of unlabeled fragmented RNA to a second array of oligonucleotide probes, wherein the second array comprises the responsive set of oligonucleotide probes attached to a conductive substrate;

i) detecting the unlabeled fragmented RNA hybridized to the responsive set of probes to determine the stable isotope incorporation into the community of organisms using imaging mass spectrometry or spectroscopy.

24. The method of claim 23, wherein said organism is a bacterium, archaea, virus, fungus, plant, arthropod, nematode, or other eukaryote.

25. The method of claim 24, wherein said organism is a bacterium.

26. The method of claim 23, wherein the stable isotopes are selected from the group consisting of $^3H$, $^{13}C$, $^{15}N$, and $^{18}O$.

27. The method of claim 23, wherein in step b) the extracting step is carried out by physical or chemical cell lysis followed by affinity column purification.

28. The method of claim 23, wherein in step c) the fragmenting step is carried out by using enzymes, chemicals, or heat, or a combination of these.

29. The method of claim 23, wherein in step e) the RNA is labeled with a fluorescent molecule or a non-fluorescent molecule.

30. The method of claim 23, wherein steps c) and e) are carried out concurrently.

31. The method of claim 23, wherein step f) further comprises the steps of adding said labeled fragmented RNA to a hybridization solution and contacting said hybridization solution with the array of oligonucleotide probes.

32. The method of claim 23, wherein the set of oligonucleotide probes comprises 16S rRNA phylogenetic oligonucleotide probes.

33. The method of claim 32, wherein said set of 16S rRNA phylogenetic probes further comprises probes from the 16S rRNA gene, 23S rRNA gene, 5S rRNA gene, 5.8S rRNA gene, 12S rRNA gene, 18S rRNA gene, 28S rRNA gene, gyrB gene, rpoB gene, fusA gene, recA gene, cox1 gene, nif13 gene, or a combination thereof.

34. The method of claim 29, wherein the RNA is labeled with a fluorescent molecule.

35. The method of claim 29, wherein the RNA is labeled with a non-fluorescent molecule.

36. The method of claim 23, wherein in step f) the hybridized labeled RNA is imaged with a fluorescence scanner and fluorescence intensity is measured for each probe feature.

37. The method of claim 23, wherein in step f) the detection of hybridization signal strength provides a determination of genes present in the community of organisms.

38. The method of claim 23, wherein in step f) the detection of hybridization signal strength is used for normalization of isotope signals detected in step i).

39. The method of claim 23, wherein in step i) the hybridized unlabeled fragmented RNA are imaged with a secondary ion mass spectrometer and isotope ratios are measured for each probe feature.

40. The method of claim 23, wherein in step i) the hybridized unlabeled fragmented RNA are imaged with a nanoscale secondary ion mass spectrometer device and isotope ratios are measured for each probe feature.

41. The method of claim 23, wherein in step f) the substrate is a solid planar substrate, a microarray slide, spheres or beads, wherein the substrate is comprised of silicon, glass, metals, semiconductor materials, polymers or plastics.

42. The method of claim 23, wherein in step h) the responsive probe substrate is a solid planar substrate, a microarray slide, spheres or beads, wherein the responsive probe substrate is comprised of silicon, glass, metals, semiconductor materials, polymers or plastics.

43. The method of claim 25, wherein the responsive probe substrate is a solid planar substrate coated with indium tin oxide (ITO).

* * * * *